US012760297B2

(12) United States Patent
Zhang et al.

(10) Patent No.: US 12,760,297 B2
(45) Date of Patent: Oct. 13, 2026

(54) CRISPR/CAS-CYTIDINE DEAMINASE BASED COMPOSITIONS, SYSTEMS, AND METHODS FOR TARGETED NUCLEIC ACID EDITING

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Feng Zhang, Cambridge, MA (US); Jonathan Gootenberg, Cambridge, MA (US); David Benjamin Turitz Cox, Cambridge, MA (US); Omar Abudayyeh, Cambridge, MA (US); Soumya Kannan, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US)

( * ) Notice: Subject to any disclaimer, the term of this patent is extended or adjusted under 35 U.S.C. 154(b) by 594 days.

(21) Appl. No.: 16/623,799

(22) PCT Filed: Jun. 26, 2018

(86) PCT No.: PCT/US2018/039618
§ 371 (c)(1),
(2) Date: Dec. 18, 2019

(87) PCT Pub. No.: WO2019/005886
PCT Pub. Date: Jan. 3, 2019

(65) Prior Publication Data

US 2020/0248169 A1 Aug. 6, 2020

Related U.S. Application Data

(60) Provisional application No. 62/591,564, filed on Nov. 28, 2017, provisional application No. 62/534,063, filed on Jul. 18, 2017, provisional application No. 62/528,396, filed on Jul. 3, 2017, provisional application No. 62/525,184, filed on Jun. 26, 2017.

(51) Int. Cl.

| | |
|---|---|
| ***C12N 9/22*** | (2006.01) |
| ***C12N 9/78*** | (2006.01) |
| ***C12N 15/10*** | (2006.01) |

(52) U.S. Cl.
CPC ............ *C12N 15/102* (2013.01); *C12N 9/22* (2013.01); *C12N 9/78* (2013.01); *C12N 2310/20* (2017.05); *C12Y 305/04005* (2013.01)

(58) Field of Classification Search
CPC ........................................................ C12N 9/22
See application file for complete search history.

(56) References Cited

U.S. PATENT DOCUMENTS

| | | | |
|---|---|---|---|
| 8,697,359 | B1 | 4/2014 | Zhang |
| 8,771,945 | B1 | 7/2014 | Zhang |
| 8,795,965 | B2 | 8/2014 | Zhang |
| 8,865,406 | B2 | 10/2014 | Zhang et al. |
| 8,871,445 | B2 | 10/2014 | Cong et al. |
| 8,889,356 | B2 | 11/2014 | Zhang |
| 8,889,418 | B2 | 11/2014 | Zhang et al. |
| 8,895,308 | B1 | 11/2014 | Zhang et al. |
| 8,906,616 | B2 | 12/2014 | Zhang et al. |
| 8,932,814 | B2 | 1/2015 | Cong et al. |
| 8,945,839 | B2 | 2/2015 | Zhang |
| 8,993,233 | B2 | 3/2015 | Zhang et al. |
| 8,999,641 | B2 | 4/2015 | Zhang et al. |
| 2014/0170753 | A1 | 6/2014 | Zhang |
| 2014/0179006 | A1 | 6/2014 | Zhang |
| 2014/0179770 | A1 | 6/2014 | Zhang et al. |
| 2014/0186843 | A1 | 7/2014 | Zhang et al. |
| 2014/0186919 | A1 | 7/2014 | Zhang et al. |
| 2014/0186958 | A1 | 7/2014 | Zhang et al. |
| 2014/0189896 | A1 | 7/2014 | Zhang et al. |
| 2014/0227787 | A1 | 8/2014 | Zhang |
| 2014/0234972 | A1 | 8/2014 | Zhang |
| 2014/0242664 | A1 | 8/2014 | Zhang et al. |
| 2014/0242699 | A1 | 8/2014 | Zhang |

(Continued)

FOREIGN PATENT DOCUMENTS

| | | | |
|---|---|---|---|
| EP | 2 764 103 | A2 | 8/2014 |
| EP | 2 771 468 | A1 | 9/2014 |

(Continued)

OTHER PUBLICATIONS

Smargon et al., "Cas13b Is a Type VI-B CRISPR-Associated RNAGuided RNase Differentially Regulated by Accessory Proteins Csx27 and Csx28", Molecular Cell, Feb. 2017, 65:618-630.*
Yamano et al., "Crystal Structure ofCpf1inComplexwithGuideRNA and Target DNA", Cell, vol. 165, pp. 949-962. (Year: 2016).*
Yu et al., "Synthetic fusion protein design and applications", Biotechnology Advances, vol. 33, pp. 155-164. (Year: 2015).*
Leptotrichia buccalis C-1013-b NCBI Taxonmy ID—Retrived from < https://www.ncbi.nlm.nih.gov/Taxonomy/Browser/wwwtax.cgi?mode=Info&id=523794 > on Oct. 9, 2024.*
"International Preliminary Report on Patentability issued in International Application No. PCT/US2018/039618", mailed on Jan. 9, 2020, 10 pages.

(Continued)

*Primary Examiner* — Suzanne M Noakes
(74) *Attorney, Agent, or Firm* — F. Brent Nix, Esq. Johnson, Marcou, Isaacs & Nix, LLC; Drew P. Harding

(57) ABSTRACT

The invention provides for systems, methods, and compositions for targeting and editing nucleic acids. In particular, the invention provides non-naturally occurring or engineered RNA-targeting systems comprising a RNA-targeting Cas protein, at least one guide molecule, and at least one cytidine deaminase protein or catalytic domain thereof.

39 Claims, 33 Drawing Sheets

Specification includes a Sequence Listing.

(56) References Cited

U.S. PATENT DOCUMENTS

| | | | |
|---|---|---|---|
| 2014/0242700 | A1 | 8/2014 | Zhang et al. |
| 2014/0248702 | A1 | 9/2014 | Zhang et al. |
| 2014/0256046 | A1 | 9/2014 | Zhang et al. |
| 2014/0273231 | A1 | 9/2014 | Zhang et al. |
| 2014/0273232 | A1 | 9/2014 | Zhang et al. |
| 2014/0273234 | A1 | 9/2014 | Zhang et al. |
| 2014/0287938 | A1 | 9/2014 | Zhang et al. |
| 2014/0310830 | A1 | 10/2014 | Zhang et al. |
| 2015/0184139 | A1 | 7/2015 | Zhang et al. |
| 2015/0232883 | A1 | 8/2015 | Dahlman et al. |
| 2016/0208243 | A1 | 7/2016 | Zhang et al. |
| 2017/0121693 | A1 | 5/2017 | Liu et al. |
| 2017/0321198 | A1 | 11/2017 | Severinov et al. |
| 2018/0179503 | A1* | 6/2018 | Maianti .............. C07K 14/7158 |
| 2019/0359971 | A1* | 11/2019 | Zhang .................. C12N 15/102 |
| 2020/0018162 | A1* | 1/2020 | Price ....................... G01J 3/027 |

FOREIGN PATENT DOCUMENTS

| | | | |
|---|---|---|---|
| EP | 2 784 162 | A1 | 10/2014 |
| EP | 3 009 511 | A2 | 4/2016 |
| WO | 2014/018423 | A2 | 1/2014 |
| WO | 2014/093595 | A1 | 6/2014 |
| WO | 2014/093622 | A2 | 6/2014 |
| WO | 2014/093635 | A1 | 6/2014 |
| WO | 2014/093655 | A2 | 6/2014 |
| WO | 2014/093661 | A2 | 6/2014 |
| WO | 2014/093694 | A1 | 6/2014 |
| WO | 2014/093701 | A1 | 6/2014 |
| WO | 2014/093709 | A1 | 6/2014 |
| WO | 2014/093712 | A1 | 6/2014 |
| WO | 2014/093718 | A1 | 6/2014 |
| WO | 2014/204723 | A1 | 12/2014 |
| WO | 2014/204724 | A1 | 12/2014 |
| WO | 2014/204725 | A1 | 12/2014 |
| WO | 2014/204726 | A1 | 12/2014 |
| WO | 2014/204727 | A1 | 12/2014 |
| WO | 2014/204728 | A1 | 12/2014 |
| WO | 2014/204729 | A1 | 12/2014 |
| WO | 2015/058052 | A1 | 4/2015 |
| WO | 2015/070083 | A1 | 5/2015 |
| WO | 2015/089351 | A1 | 6/2015 |
| WO | 2015/089354 | A1 | 6/2015 |
| WO | 2015/089364 | A1 | 6/2015 |
| WO | 2015/089419 | A2 | 6/2015 |
| WO | 2015/089427 | A1 | 6/2015 |
| WO | 2015/089462 | A1 | 6/2015 |
| WO | 2015/089465 | A1 | 6/2015 |
| WO | 2015/089473 | A1 | 6/2015 |
| WO | 2015/089486 | A2 | 6/2015 |
| WO | 2016/028682 | A1 | 2/2016 |
| WO | 2016/049163 | A2 | 3/2016 |
| WO | 2016/049258 | A2 | 3/2016 |
| WO | 2016/069591 | A2 | 5/2016 |
| WO | 2016/094867 | A1 | 6/2016 |
| WO | 2016/094874 | A1 | 6/2016 |
| WO | 2016/094880 | A1 | 6/2016 |
| WO | 2016/100974 | A1 | 6/2016 |
| WO | 2016/106244 | A1 | 6/2016 |
| WO | 2016/094872 | A9 | 8/2016 |
| WO | 2016/205749 | A1 | 12/2016 |
| WO | 2016/205759 | A1 | 12/2016 |
| WO | 2016205764 | A1 | 12/2016 |
| WO | 2017/070605 | A1 | 4/2017 |
| WO | 2017/106290 | A1 | 6/2017 |
| WO | 2017/219027 | A1 | 12/2017 |
| WO | 2018/035250 | A1 | 2/2018 |
| WO | 2019/010384 | A1 | 1/2019 |
| WO | 2019/089803 | A1 | 5/2019 |
| WO | 2019/113506 | A1 | 6/2019 |
| WO | 2020/006036 | A1 | 1/2020 |

OTHER PUBLICATIONS

"International Search Report and Written Opinion issued in International Application No. PCT/US2018/039618", mailed on Nov. 2, 2018, 13 pages.

"Invitation to Pay Additional Fees for PCT/US2018/039618", 2 pages.

Abudayyeh, et al., "C2C2 is a Single-Component Programmable RNA-Guided RNA-Targeting CRISPR Effector", Science, vol. 353, No. 6299, Aug. 5, 2016, 23 pages.

Canver, et al., "BCL11A Enhancer Dissection by Cas9-Mediated In Situ Saturating Mutagenesis", Nature, vol. 527, Nov. 12, 2015, 23 pages.

Chen, et al., "Genome-Wide CRISPR Screen in a Mouse Model of Tumor Growth and Metastasis", Cell, vol. 160, No. 6, Mar. 12, 2015, 28 pages.

Chen, et al., "Targeted Activation of Diverse CRISPR-Cas Systems for Mammalian Genome Editing via Proximal CRISPR Targeting", Nature Communications, vol. 8, Article 14958, Apr. 7, 2017, 12 pages.

Cong, et al., "Multiplex Genome Engineering Using CRISPR/Cas Systems", Science, vol. 339, No. 6121, Feb. 15, 2013, 819-823.

Doench, et al., "Rational Design of Highly Active SgRNAs for CRISPR-Cas9-Mediated Gene Inactivation", Nature Biotechnology, vol. 32, No. 12, Dec. 2014, 17 pages.

Gao, et al., "Engineered Cpf1 Enzymes with Altered PAM Specificities", Nature Biotechnology, vol. 35, No. 8, Dec. 4, 2016, 17 pages.

Harris, et al., "RNA Editing Enzyme APOBEC1 and Some of Its Homologs Can Act as DNA Mutators", Molecular Cell, vol. 10, Issue 5, Nov. 2002, 1247-1253.

Hsu, et al., "Development and Applications of CRISPR-Cas9 for Genome Engineering", Cell, vol. 157, No. 6, Jun. 5, 2014, 34 pages.

Hsu, et al., "DNA Targeting Specificity of RNA-Guided Cas9 Nucleases", Nature Biotechnology, vol. 31, No. 9, Sep. 2013, 827-832.

Jiang, et al., "RNA-Guided Editing of Bacterial Genomes Using CRISPR-Cas Systems", Nature Biotechnology, vol. 31, No. 3, Mar. 2013, 9 pages.

Kim, et al., "Increasing the Genome-Targeting Scope and Precision of Base Editing with Engineered Cas9-Cytidine Deaminase Fusions", Nature Biotechnology, vol. 35, No. 4, Feb. 13, 2017, 371-377.

Komor, et al., "Programmable Editing of a Target Base in Genomic DNA without Double-Stranded DNA Cleavage", Nature, vol. 533, No. 7603, May 19, 2016, 25 pages.

Konermann, et al., "Genome-Scale Transcriptional Activation by an Engineered CRISPR-Cas9 Complex", Nature, vol. 517, No. 7536, Jan. 29, 2015, 18 pages.

Konermann, et al., "Optical Control of Mammalian Endogenous Transcription and Epigenetic States", Nature, vol. 500, No. 7463, Aug. 22, 2013, 18 pages.

Lada, "Mutator Effects and Mutation Signatures of Editing Deaminases Produced in Bacteria and Yeast", Biochemistry, vol. 76, No. 1, Jan. 2011, 29 pages.

Nishimasu, et al., "Crystal Structure of Cas9 in Complex with Guide RNA and Target DNA", Cell, vol. 156, No. 5, Feb. 27, 2014, 25 pages.

Nishimasu, et al., "Crystal Structure of Staphylococcus Aureus Cas9", Cell, vol. 162, No. 5, Aug. 27, 2015, 24 pages.

Parnas, et al., "A Genome-Wide CRISPR Screen in Primary Immune Cells to Dissect Regulatory Networks", Cell, vol. 162, No. 3, Jul. 30, 2015, 24 pages.

Platt, et al., "CRISPR-Cas9 Knockin Mice for Genome Editing and Cancer Modeling", Cell, vol. 159, No. 2, Oct. 9, 2014, 31 pages.

Ramanan, et al., "CRISPR/Cas9 Cleavage of Viral DNA Efficiently Suppresses Hepatitis B Virus", Scientific Reports, vol. 5, No. 10833, Jun. 2, 2015, 9 pages.

Ran, et al., "Double Nicking by RNA-Guided CRISPR Cas9 for Enhanced Genome Editing Specificity", Cell, vol. 154, No. 6, Sep. 12, 2013, 19 pages.

Ran, et al., "Genome Engineering Using the CRISPR-Cas9 System", Nature Protocols, vol. 8, No. 11, Nov. 2013, 49 pages.

(56) References Cited

OTHER PUBLICATIONS

Ran, et al., "In Vivo Genome Editing Using *Staphylococcus aureus* Cas9", Nature, vol. 520, No. 7546, Apr. 9, 2015, 28 pages.
Shalem, et al., "Genome-Scale CRISPR-Cas9 Knockout Screening in Human Cells", Science, vol. 343, No. 6166, Jan. 3, 2014, 10 pages.
Shalem, et al., "High-Throughput Functional Genomics Using CRISPR-Cas9", Nature Reviews Genetics, vol. 16, No. 5, May 2015, 28 pages.
Shimatani, et al., "Targeted Base Editing in Rice and Tomato Using a Crispr-cas9 Cytidine Deaminase Fusion", Nature Biotechnology, vol. 35, No. 5, Mar. 27, 2017, 5 pages.
Shmakov, et al., "Discovery and Functional Characterization of Diverse Class 2 CRISPR-Cas Systems", Molecular Cell, vol. 60, No. 3, Nov. 5, 2015, 23 pages.
Slaymaker, et al., "Rationally Engineered Cas9 Nucleases with Improved Specificity", Science, vol. 351, No. 6268, Jan. 1, 2016, 10 pages.
Swiech, et al., "In Vivo Interrogation of Gene Function in the Mammalian Brain Using CRISPR-Cas9", Nature Biotechnology, vol. 33, No. 1, Jan. 2015, 9 pages.
Tan, et al., "Efficient Nonmeiotic Allele Introgression in Livestock Using Custom Endonucleases", Proceedings of the National Academy of Sciences, vol. 110, No. 41, Oct. 2013, 16526-16531.
Tsai, et al., "Dimeric CRISPR RNA-Guided Fokl Nucleases for Highly Specific Genome Editing", Nature Biotechnology, vol. 32, No. 6, Jun. 2014, 569-577.
Wang, et al., "Genetic Screens in Human Cells Using the CRISPR/Cas9 System", Science, vol. 343, No. 6166, Jan. 3, 2014, 12 pages.
Wang, et al., "One-Step Generation of Mice Carrying Mutations in Multiple Genes by CRISPR/Cas-Mediated Genome Engineering", Cell, vol. 153, No. 4, May 9, 2013, 13 pages.
Wu, et al., "Genome-Wide Binding of the CRISPR Endonuclease Cas9 in Mammalian Cells", Nature Biotechnology, vol. 32, No. 7, Jul. 2014, 20 pages.
Xu, et al., "Sequence Determinants of Improved CRISPR SgRNA Design", Genome Research, vol. 25, No. 8, Aug. 2015, 1147-1157.
Yan, et al., "Cas13d Is a Compact RNA-Targeting Type VI CRISPR Effector Positively Modulated by a WYL-Domain-Containing Accessory Protein", Molecular Cell, vol. 70, No. 2, Apr. 19, 2018, 327-339.
Yang, et al., "Engineering and Optimising Deaminase Fusions for Genome Editing", Nature Communications, vol. 7, Article No. 13330, Nov. 2, 2016, 12 pages.
Zetsche, et al., "A Split-Cas9 Architecture for Inducible Genome Editing and Transcription Modulation", Nature Biotechnology, vol. 33, No. 2, Feb. 2015, 139-142.
Zetsche, et al., "Cpf1 is a Single RNA-Guided Endonuclease of a Class 2 CRISPR-Cas System", Cell, vol. 163, No. 3, Oct. 22, 2015, 14 pages.
Zong, et al., "Precise Base Editing in Rice, Wheat and Maize with a Cas9-cytidine Deaminase Fusion", Nature Biotechnology, vol. 35, No. 5, Feb. 27, 2017, 5 pages.

* cited by examiner

C

D

E

F

F

G

CRISPR/CAS-CYTIDINE DEAMINASE BASED COMPOSITIONS, SYSTEMS, AND METHODS FOR TARGETED NUCLEIC ACID EDITING

CROSS-REFERENCE TO RELATED APPLICATIONS

This application is a national stage of International Application No. PCT/US2018/039618 filed Jun. 26, 2018, which claims the benefit of U.S. Provisional Application No. 62/525,184, fled Jun. 26, 2017, U.S. Provisional Application No. 62/528,396, filed Jul. 3, 2017, U.S. Provisional Application No. 62/534,063, filed Jul. 18, 2017, and U.S. Provisional Application No. 62/591,564, filed Nov. 28, 2017. The entire contents of the above-identified applications are hereby fully incorporated herein by reference.

STATEMENT AS TO FEDERALLY SPONSORED RESEARCH

This invention was made with government support under grant numbers MH100706, MH110049, and HL141201 awarded by the National Institutes of Health. The government has certain rights in the invention

PARTIES TO A JOINT RESEARCH AGREEMENT

The claimed invention was made by, on behalf of, and/or in connection with one or more of the following parties to a joint research agreement: the Broad Institute, Inc., Massachusetts Institute of Technology, and the President and Fellows of Harvard College. The joint research agreement was in effect on and before the date the claimed invention was made, and the claimed invention was made as a result of activities undertaken within the scope of the joint research agreement.

REFERENCE TO DOCUMENTS CO-FILED IN COMPUTER READABLE FORMAT

An ASCII compliant text file entitled "Clin_var_pathogenic_SNPS_TC.txt" created on Jul. 3, 2017 and 891043 bytes in size is filed herewith via EFS-WEB, the contents of which are hereby incorporated herein by reference.

REFERENCE TO AN ELECTRONIC SEQUENCE LISTING

The contents of the electronic sequence listing ("BROD-2179US_ST25. txt"; Size is 1,422,842 bytes and it was created on Mar. 10, 2023) is herein incorporated by reference in its entirety.

FIELD OF THE INVENTION

The present invention generally relates to systems, methods, and compositions for targeting and editing nucleic acids, in particular for programmable deamination of cytosine at a target RNA.

BACKGROUND

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

Point mutations A→G and T(U)→C represent about 12% of known pathogenic SNPs. Programmable deamination of cytosine has been reported and may be used for correction of A→G and T(U)→C point mutations. For example, Komor et al., Nature (2016) 533:420-424 reports targeted deamination of cytosine by APOBEC1 cytidine deaminase in a non-targeted DNA stranded displaced by the binding of a Cas9-guide RNA complex to a targeted DNA strand, which results in conversion of cytosine to uracil. See also Kim et al., Nature Biotechnology (2017) 35:371-376; Shimatani et al., Nature Biotechnology (2017) doi: 10.1038/nbt.3833; Zong et al., Nature Biotechnology (2017) doi: 10.1038/nbt.3811; Yang Nature Communication (2016) doi: 10.1038/ncomms13330.

Novel systems and methods which allow specific correction of these point mutations and pathogenic SNPs, in particular at the RNA level instead of at the DNA level, are of interest.

SUMMARY OF THE INVENTION

At least a first aspect of the invention relates to a method of modifying an Cytosine in a target RNA, the method comprising delivering to the locus: (a) a catalytically inactive Cas13 protein; (b) a guide molecule which comprises a guide sequence linked to a direct repeat sequence; and (c) a cytidine deaminase protein or catalytic domain thereof; wwherein said cytidine deaminase protein or catalytic domain thereof is covalently or non-covalently linked to said catalytically inactive Cas13 protein or said guide molecule or is adapted to link thereto after delivery; wherein said guide molecule forms a complex with said catalytically inactive Cas13 and directs said complex to bind said target RNA, wherein said guide sequence is capable of hybridizing with a target sequence within said target RNA to form an RNA duplex; wherein: (A) said Cytosine is outside said target sequence that forms said RNA duplex, wherein said cytidine deaminase protein or catalytic domain thereof deaminates said Cytosine outside said RNA duplex, or (B) said Cytosine is within said target sequence that forms said RNA duplex, wherein said guide sequence comprises a non-pairing Adenine or Uracil at a position corresponding to said Cytosine resulting in a C-A or C-U mismatch in said RNA duplex, and wherein the cytidine deaminase protein or catalytic domain thereof deaminates the Cytosine in the RNA duplex opposite to the non-pairing Adenine or Uracil.

In some embodiments, the cytidine deaminase protein or catalytic domain thereof is fused to N- or C-terminus of the catalytically inactive Cas13 protein. In some embodiments, the cytidine protein or catalytic domain thereof is fused to the catalytically inactive Cas13 protein by a linker. In some embodiments, the linker is $(GGGGS)_{3-11}$ (SEQ ID NOS:

1-9), $GSG_5$ (SEQ ID NO: 10) or LEPGEKPYKCPECGKSFSQSGALTRHQRTHTR (SEQ ID NO: 11).

In some embodiments, the cytidine deaminase protein or catalytic domain thereof is linked to an adaptor protein and the guide molecule or the catalytically inactive Cas13 protein comprises an aptamer sequence capable of binding to the adaptor protein. In some embodiments, the adaptor sequence is selected from MS2, PP7, Qβ, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s and PRR1.

In some embodiments, the cytidine deaminase protein or catalytic domain thereof is inserted into an internal loop of the catalytically inactive Cas13 protein.

In some embodiments, the catalytically inactive Cas13 protein comprises a mutation in the HEPN domain. In some embodiments, the catalytically inactive Cas13 protein has at least part of the HEPN domain removed.

In some embodiments, the catalytically inactive Cas13 protein is a Cas13a/C2c2, Cas13b, or Cas13c protein.

In some embodiments, the catalytically inactive Cas13 protein is obtained from a Cas13a nuclease derived from a bacterial species selected from the group consisting of *Leptotrichia shahii, Lachnospiraceae bacterium, Lachnospiraceae bacterium, Clostridium aminophilum, Carnobacterium Paludibacter gallinarum, propionicigenes, Listeria weihenstephanensis, Listeriaceae bacterium, Listeria newyorkensis, Leptotrichia wadei, Rhodobacter capsulatus, Rhodobacter capsulatus, Rhodobacter capsulatus, Leptotrichia wadei*, or *Listeria seeligeri.*

In some embodiments, the catalytically inactive Cas13 protein is obtained from a Cas13b nuclease derived from a bacterial species selected from the group consisting of *Porphyromonas gulae, Prevotella* sp., *Porphyromonas gingivalis, Bacteroides pyogenes, Riemerella anatipestifer, Bergeyella zoohelcum, Prevotella intermedia, Prevotella buccae, Alistipes* sp., *Prevotella aurantiaca, Myroides odoratimimus, Capnocytophaga canimorsus, Flavobacterium branchiophilum*, and *Flavobacterium columnare.*

In some embodiments, the catalytically inactive Cas13 protein has been modified to and recognizes an altered PAM sequence.

In some embodiments, the guide molecule binds to the catalytically inactive Cas13 protein and is capable of forming a RNA duplex of about 15-30 nt with the target sequence. In some embodiments, the guide molecule binds to the catalytically inactive Cas13 protein and is capable of forming a RNA duplex of more than 30 nt with the target sequence.

In some embodiments, the guide sequence of the guide molecule comprises at least one further mismatches or non-pairing nucleotide with the target sequence, adjacent to said non-pairing Adenine or Uracil. In some embodiments, the guide sequence comprises a stretch of three to five consecutive mismatches with the target sequence. In some embodiments the guide sequence comprises less than 6 consecutive mismatches with the target sequence.

In some embodiments, the guide sequence comprises at least one further non-pairing nucleotide with said target sequence, adjacent to said non-pairing Adenine or Uracil. In some embodiments, the guide sequence comprises a stretch of three to five consecutive non-pairing nucleotides with said target sequence.

In some embodiments, the cytidine deaminase is a human, rat or lamprey cytidine deaminase. In some embodiments, the cytidine deaminase is an apolipoprotein B mRNA-editing complex (APOBEC) family deaminase, an activation-induced deaminase (AID), or a cytidine deaminase 1 (CDA1).

In some embodiments, the cytidine deaminase is an APOBEC1 deaminase comprising one or more mutations corresponding to W90A, W90Y, R118A, H121R, H122R, R126A, R126E, or R132E in rat APOBEC1, or an APOBEC3G deaminase comprising one or more mutations corresponding to W285A, W285Y, R313A, D316R, D317R, R320A, R320E, or R326E in human APOBEC3G.

In some embodiments, the target RNA is within a cell. In some embodiments, the cell is a eukaryotic cell. In some embodiments, the cell is a non-human animal cell. In some embodiments, the cell is a human cell. In some embodiments, the cell is a plant cell.

In some embodiments, the target RNA is within an animal. In some embodiments, the target RNA is within a plant. In some embodiments, the target RNA is comprised in a DNA molecule in vitro.

In some embodiments, the components (a), (b) and (c) are delivered to the cell as a ribonucleoprotein complex.

In some embodiments, the components (a), (b) and (c) are delivered to the cell as one or more polynucleotide molecules. In some embodiments, the one or more polynucleotide molecules comprise one or more mRNA molecules encoding components (a) and/or (c).

In some embodiments, the one or more polynucleotide molecules are comprised within one or more vectors. In some embodiments, the one or more polynucleotide molecules comprise one or more regulatory elements operably configured to express the catalytically inactive Cas13 protein, the guide molecule, and the cytidine deaminase protein or catalytic domain thereof, optionally wherein the one or more regulatory elements comprise inducible promoters.

In some embodiments, the catalytically inactive Cas13 protein and optionally the cytidine deaminase protein or catalytic domain thereof comprise one or more heterologous nuclear export signal(s) (NES(s)).

In some embodiments, the cytidine deaminase is delivered together with a uracil glycosylase inhibitor (UGI), where the UGI is covalently linked to said cytidine deaminase and/or said catalytically inactive Cas13.

In some embodiments, the one or more polynucleotide molecules or the ribonucleoprotein complex are delivered via particles, vesicles, or one or more viral vectors.

In some embodiments, the particles comprise a lipid, a sugar, a metal or a protein. In some embodiments, the particles comprise lipid nanoparticles.

In some embodiments, the vesicles comprise exosomes or liposomes. In some embodiments, the one or more viral vectors comprise one or more of adenovirus, one or more lentivirus or one or more adeno-associated virus.

In some embodiments, the method modifies a cell, a cell line or an organism by manipulation of one or more target sequences at genomic loci of interest.

At least a second aspect of the invention relates to a method for treating or preventing a disease using the method described herein, wherein the deamination of the Cytosine at the target RNA remedies a disease caused by a T(U)→C or A→G point mutation or pathogenic SNP.

At least a third aspect of the invention relates to a method for knock-out or knock-down an undesirable activity of a gene, wherein the deamination of the Cytosine at the target RNA inactivates a target gene transcript.

At least a fourth aspect of the invention relates to a modified cell obtained from the method described above, or progeny thereof, wherein the cell comprises an Uracil or a Thymine in replace of the Cytosine in the target RNA compared to a corresponding cell not subjected to the method.

In some embodiments, the modified cell is a eukaryotic cell. In some embodiments, the modified cell is an animal cell. In some embodiments, the modified cell is a human cell. In some embodiments, the modified cell is a plant cell.

In some embodiments, the modified cell is a therapeutic T cell. In some embodiments, the modified cell is an antibody-producing B cell.

At least a fifth aspect of the invention relates to a non-human animal or a plant comprising the modified cell described herein.

At least a sixth aspect of the invention relates to a method for cell therapy, comprising administering to a patient in need thereof the modified cell described herein, wherein the presence of the modified cell remedies a disease in the patient.

At least a seventh aspect of the invention relates to an engineered, non-naturally occurring system suitable for modifying an Cytosine in a target RNA, comprising: a guide molecule which comprises a guide sequence linked to a direct repeat, or a nucleotide sequence encoding the guide molecule; a catalytically inactive Cas13 protein, or one or more nucleotide sequences encoding the catalytically inactive Cas13 protein; a cytidine deaminase protein or catalytic domain thereof, or one or more nucleotide sequences encoding; wherein said cytidine deaminase protein or catalytic domain thereof is covalently or non-covalently linked to said catalytically inactive Cas13 protein or said guide molecule or is adapted to link thereto after delivery; wherein said guide sequence is capable of hybridizing with a target sequence within said target RNA to form an RNA duplex; wherein: (A) said Cytosine is outside said target sequence that forms said RNA duplex, or (B) said Cytosine is within said target sequence that forms said RNA duplex and wherein said guide sequence comprises a non-pairing Adenine or Uracil at a position corresponding to said Cytosine resulting in a C-A or C-U mismatch in said RNA duplex. Accordingly, the application provides kits comprising or consisting of the components of the CD-functionalized CRISPR system described herein.

At least an eighth aspect of the invention relates to an engineered, non-naturally occurring vector system suitable for modifying an Cytosine in a target RNA, comprising one or more vectors comprising: a first regulatory element operably linked to one or more nucleotide sequences encoding a guide molecule which comprises a guide sequence linked to a direct repeat; a second regulatory element operably linked to a nucleotide sequence encoding a catalytically inactive Cas13 protein; and optionally a nucleotide sequence encoding a cytidine deaminase protein protein or catalytic domain thereof which is under control of the first or second regulatory element or operably linked to a third regulatory element; wherein, if the nucleotide sequence encoding a cytidine deaminase protein or catalytic domain thereof is operably linked to a third regulatory element, the cytidine deaminase protein or catalytic domain thereof is adapted to link to the guide molecule or the catalytically inactive Cas13 protein after expression; wherein components (a), (b) and (c) are located on the same or different vectors of the system. Accordingly, the application provides kits comprising or consisting of vectors encoding of the components of the CD-functionalized CRISPR system described herein.

At least a ninth aspect of the invention relates to in vitro, ex vivo or in vivo host cell or cell line or progeny thereof comprising the engineered, non-naturally occurring system or vector system described herein.

In some embodiments, the host cell is a eukaryotic cell. In some embodiments, the host cell is an animal cell. In some embodiments, the host cell is a human cell. In some embodiments, the host cell is a plant cell.

In another aspect, the invention is directed to an engineered composition for site-directed base editing comprising a targeting domain and a cytodine deaminase, or catalytic domain thereof. In particular embodiments, the targeting domain is an oligonucleotide binding domain. In particular embodiments, the cytodine deaminase, or catalytic domain thereof, comprises one or more mutations that increase activity or specificity of the cytodine deaminase relative to wild type. In particular embodiments, the targeting domain is a CRISPR system comprising a CRISPR effector protein, or functional domain thereof, and a guide molecule, more particularly the CRISPR system is catalytically inactive. In particular embodiments, the CRISPR system comprises an RNA-binding protein, preferably Cas13, preferably the Cas13 protein is Cas13a, Cas13b or Cas13c, preferably wherein said Cas13 a Cas13 listed in any of Tables 1, 2, 3, 4, or 6 or is from a bacterial species listed in any of Tables 1, 2, 3, 4, or 6, preferably wherein said Cas13 protein is *Prevotella* sp.P5-125 Cas13b, *Porphyromas gulae* Cas13b, or *Riemerella anatipestifer* Cas13b; preferably *Prevotella* sp.P5-125 Cas13b. In particular embodiments, the Cas13 protein is a Cas13a protein and said Cas13a comprises one or more mutations the two HEPN domains, particularly at position R474 and R1046 of Cas13a protein originating from *Leptotrichia wadei* or amino acid positions corresponding thereto of a Cas13a ortholog, or wherein said Cas13 protein is a Cas13b protein and said Cas13b comprises a mutation in one or more of positions R116, H121, R1177, H1182, preferably R116A, H121A, R1177A, H1182A of Cas13b protein originating from *Bergeyella zoohelcum* ATCC 43767 or amino acid positions corresponding thereto of a Cas13b ortholog, or wherein said Cas13 protein is a Cas13b protein and said Cas13b comprises a mutation in one or more of positions R128, H133, R1053, H1058, preferably H133 and H1058, preferably H133A and H1058A, of a Cas13b protein originating from *Prevotella* sp. P5-125 or amino acid positions corresponding thereto of a Cas13b ortholog as described elsewhere herein or the Cas 13 is truncated, preferably C-terminally truncated, preferably wherein said Cas13 is a truncated functional variant of the corresponding wild type Cas13, optionally wherein said truncated Cas13b is encoded by nt 1-984 of *Prevotella* sp.P5-125 Cas13b or the corresponding nt of a Cas13b orthologue or homologue.

In particular embodiments, the guide molecule of the targeting domain comprises a guide sequence is capable of hybridizing with a target RNA sequence comprising a Cytodine to form an RNA duplex, wherein said guide sequence comprises a non-pairing adenosine or uracil at a position corresponding to said Cytodine resulting in a mismatch in the RNA duplex formed. In particular embodiments, the guide sequence has a length of about 20-53 nt, preferably 25-53 nt, more preferably 29-53 nt or 40-50 nt capable of forming said RNA duplex with said target sequence, and/or wherein the distance between said non-pairing C and the 5' end of said guide sequence is 20-30 nucleotides. In particular embodiments, the guide sequence comprises more than one mismatch corresponding to different adenosine sites in the target RNA sequence or wherein two guide molecules are used, each comprising a mismatch corresponding to a different adenosine sites in the target RNA sequence.

In particular embodiments, of the composition the cytodine deaminase protein or catalytic domain thereof is fused to a N- or C-terminus of said oligonucleotide targeting protein, optionally by a linker as described elsewhere herein. Alternatively, said cytodine deaminase protein or catalytic domain thereof is inserted into an internal loop of said dead Cas13 protein. In a further alternative embodiment, the cytodine deaminase protein or catalytic domain thereof is linked to an adaptor protein and said guide molecule or said dead Cas13 protein comprises an aptamer sequence capable of binding to said adaptor protein as described elsewhere herein.

In particular embodiments of the composition the cytodine deaminase protein or catalytic domain thereof capable of deaminating cytodine in RNA or is an RNA specific cytodine deaminase. In further particular embodiments, the deaminase protein comprises one or more mutations, more particularly the one or more mutations comprise mutations at one or more amino acid residues described herein.

In particular embodiments of the composition, the targeting domain and optionally the cytodine deaminse or catalytic domain thereof comprise one or more heterologous nuclear export signal(s) (NES(s)) or nuclear localization signal(s) (NLS(s)), preferably an HIV Rev NES or MAPK NES, preferably C-terminal.

A further aspect of the invention relates to the composition as envisaged herein for use in prophylactic or therapeutic treatment, preferably wherein said target locus of interest is within a human or animal and to methods of modifying a Cytidine in a target RNA sequence of interest, comprising delivering to said target RNA, the composition as described hereinabove. In particular embodiments, the CRISPR system and the cytodine deaminase, or catalytic domain thereof, are delivered as one or more polynucleotide molecules, as a ribonucleoprotein complex, optionally via particles, vesicles, or one or more viral vectors. In particular embodiments, the composition is for use in the treatment or prevention of a disease caused by transcripts containing a pathogenic A→G or T→C point mutation. In particular embodiments, the invention thus comprises compositions for use in therapy. This implies that the methods can be performed in vivo, ex vivo or in vitro. In particular embodiments, the methods are not methods of treatment of the animal or human body or a method for modifying the germ line genetic identity of a human cell. In particular embodiments; when carrying out the method, the target RNa is not comprised within a human or animal cell. In particular embodiments, when the target is a human or animal target, the method is carried out ex vivo or in vitro A further aspect relates to an isolated cell obtained or obtainable from the methods described above and/or comprising the composition described above or progeny of said modified cell, preferably wherein said cell comprises a hypoxanthine or a guanine in replace of said Cytodine in said target RNA of interest compared to a corresponding cell not subjected to the method. In particular embodiments, the cell is a eukaryotic cell, preferably a human or non-human animal cell, optionally a therapeutic T cell or an antibody-producing B-cell or wherein said cell is a plant cell. A further aspect provides a non-human animal or a plant comprising said modified cell or progeny thereof. Yet a further aspect provides the modified cell as described hereinabove for use in therapy, preferably cell therapy.

DETAILED DESCRIPTION

General Definitions

Figure 1:
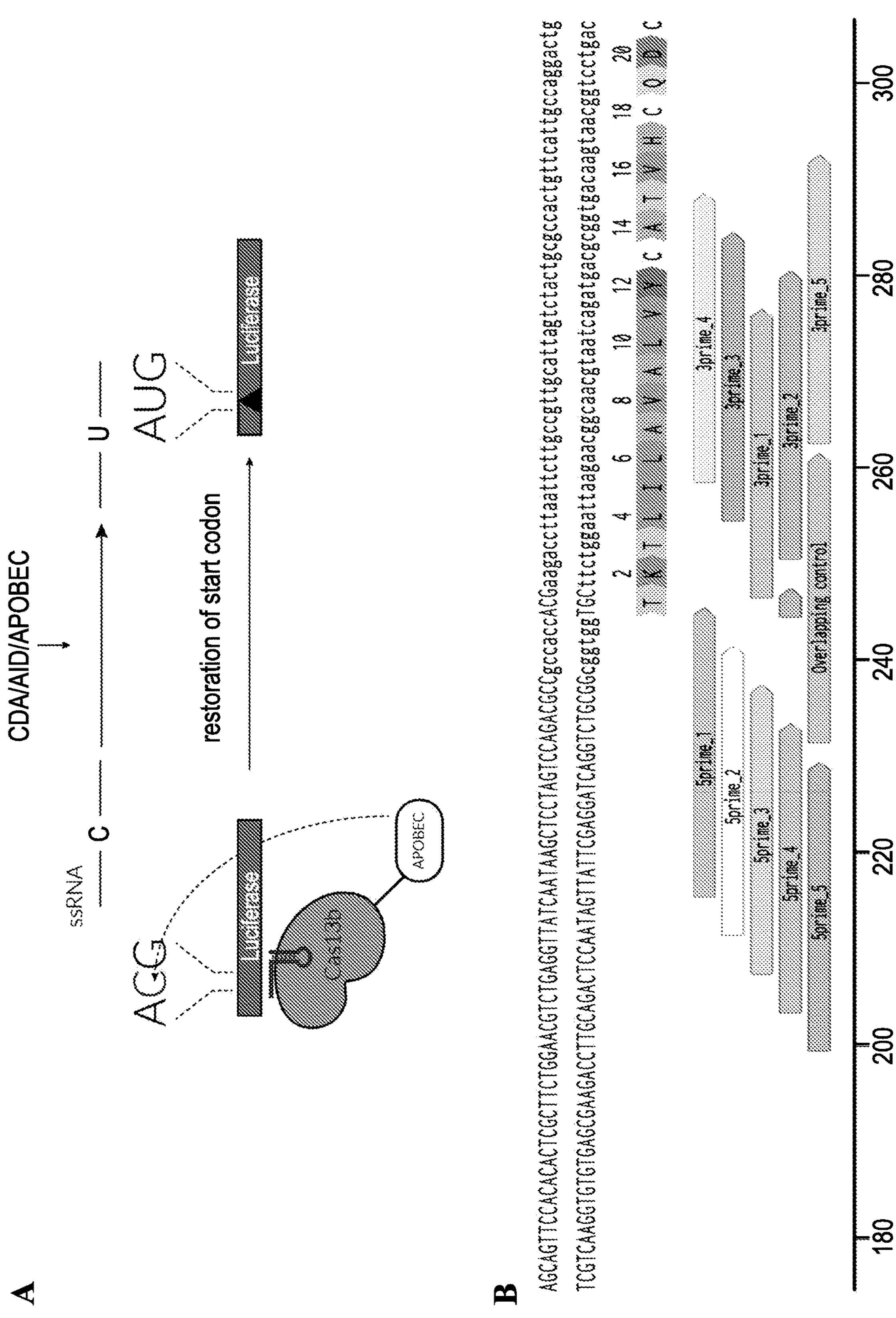
FIG. 1: (A) Schematic illustration of reactivation of start codon in Cypridina luciferase. (B) guide design. (SEQ ID NOS: 12-14)
Figure 2:
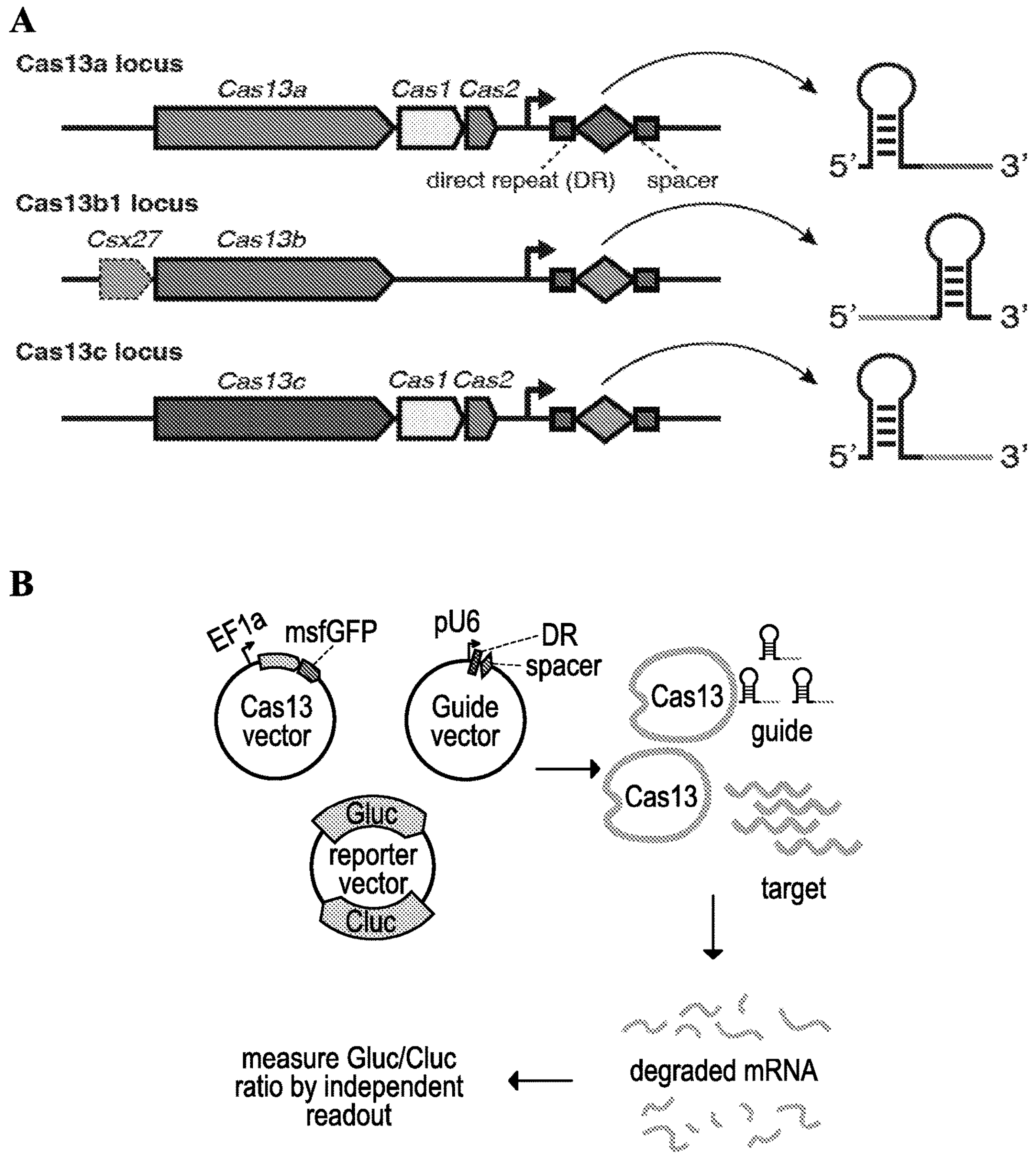
FIG. 2: Mammalian codon-optimized Cas13b orthologs mediate highly efficient RNA knockdown. (A) Schematic of representative Cas13a, Cas13b, and Cas13c loci and associated crRNAs. (B) Schematic of luciferase assay to measure Cas13a cleavage activity in HEK293FT cells. (C) RNA knockdown efficiency using two different guides targeting Cluc with 19 Cas13a, 15 Cas13b, and 5 Cas13c orthologs. Luciferase expression is normalized to the expression in non-targeting guide control conditions. (D) The top 7 orthologs performing in part C are assayed for activity with three different NLS and NES tags with two different guide RNAs targeting Cluc. (E) Cas13b12 and Cas13a2 (LwCas13a) are compared for knockdown activity against Gluc and Cluc. Guides are tiled along the transcripts and guides between Cas13b12 and Cas13a2 are position matched. (F) Guide knockdown for Cas13a2, Cas13b6, Cas13b11, and Cas13b12 against the endogenous KRAS transcript and are compared against corresponding shRNAs.
Figure 2:
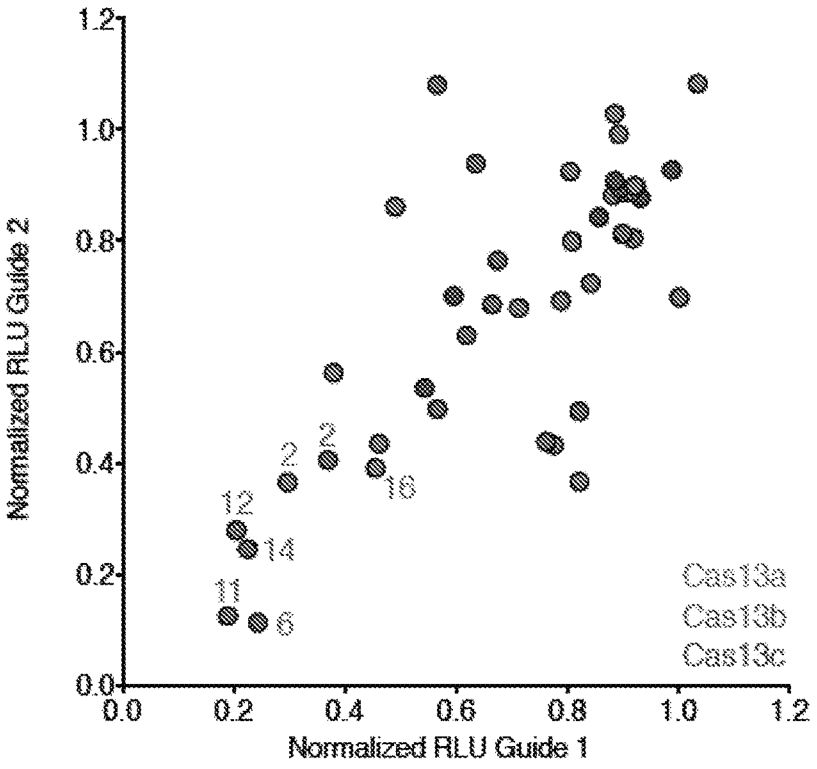
Figure 2:
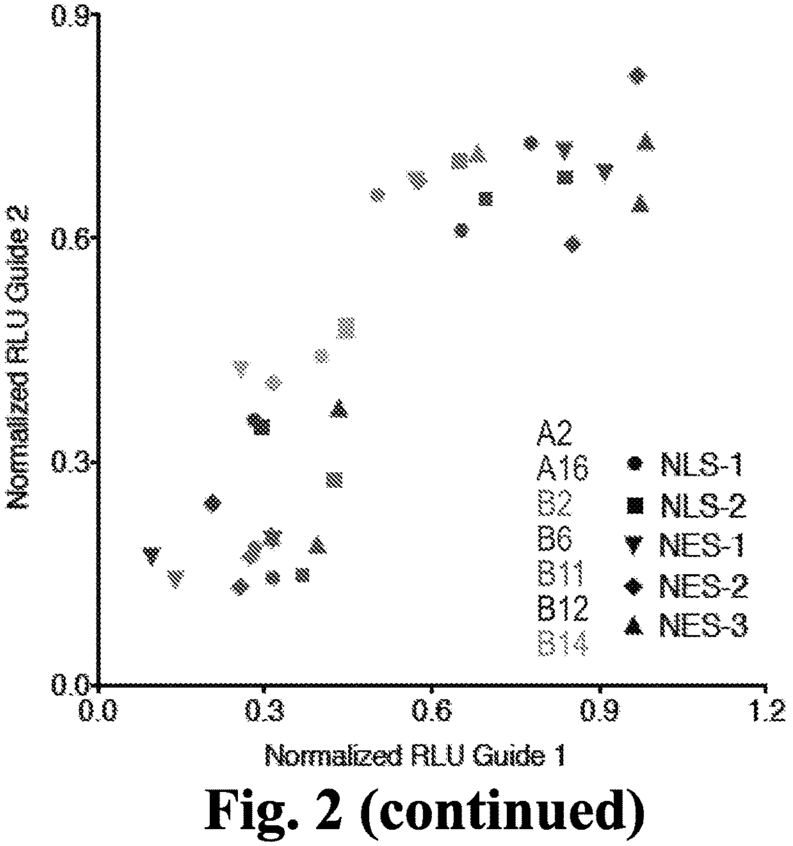
Figure 2:
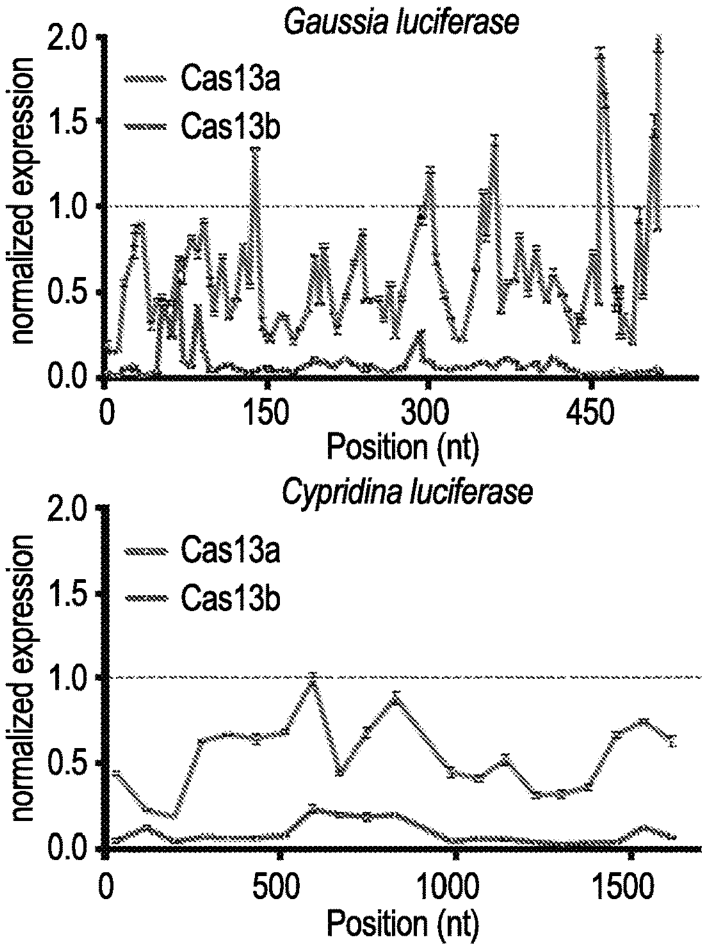
Figure 2:
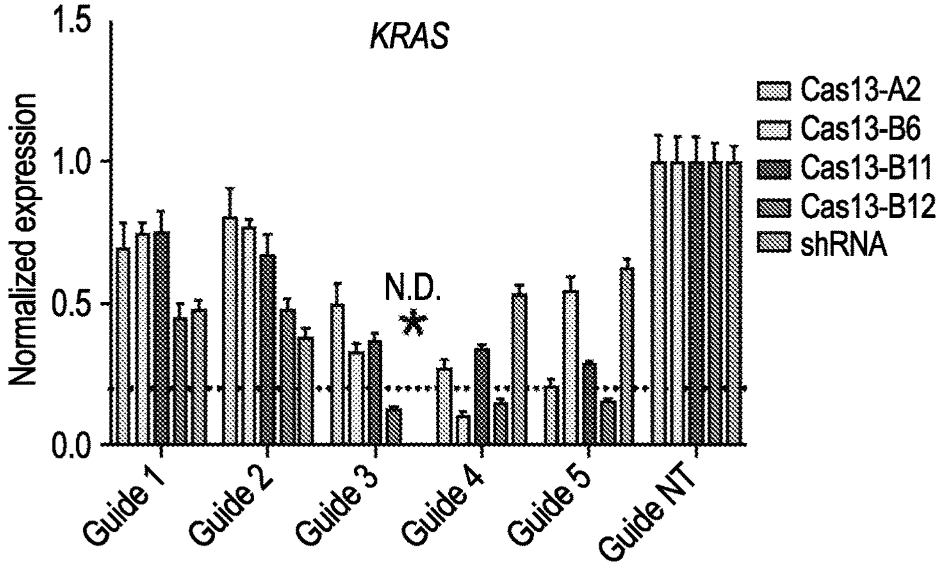
Figure 3:
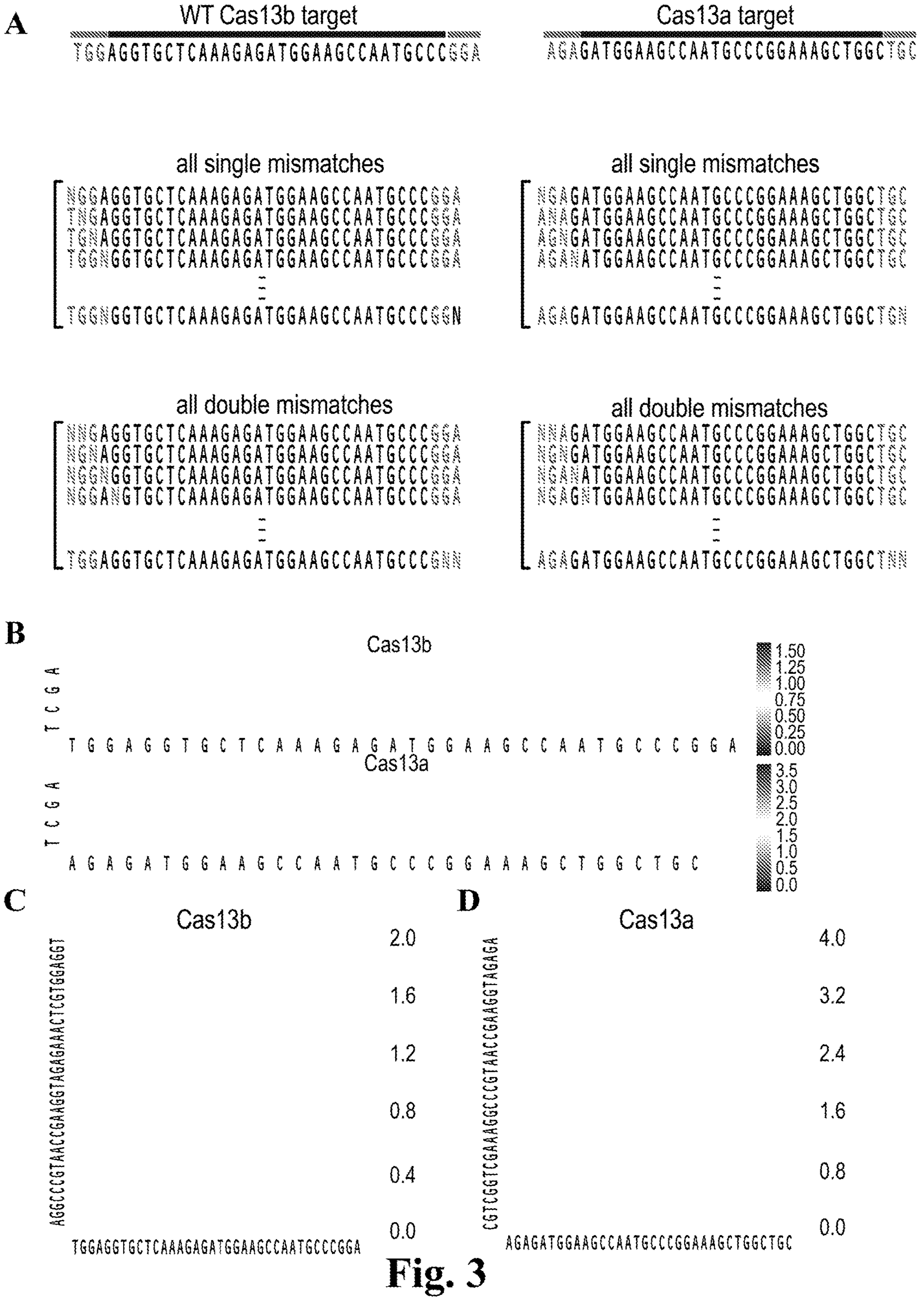
FIG. 3: Cas13 enzymes mediate specific RNA knockdown in mammalian cells. (A) Schematic of semi-degenerate target sequences for Cas13a/b mismatch specificity testing. (SEQ ID NOS: 15-36) (B) Heatmap of single mismatch knockdown data for Cas13 a/b. Knockdown is normalized to non-targeting (NT) guides for each enzyme. (C) Double mismatch knockdown data for Cas13a. The position of each mismatch is indicated on the X and Y axes. Knockdown data is the sum of all double mismatches for a given set of positions. Data is normalized to NT guides for each enzyme. (D) Double mismatch knockdown data for Cas13b. See C for description. (E) RNA-seq data comparing transcriptome-wide specificity for Cas13 a/b and shRNA for position-matched guides. The Y axis represents read counts for the targeting condition and the X axis represents counts for the non-targeting condition. (F) RNA expression as calculated from RNA-seq data for Cas13 a/b and shRNA. (G) Significant off-targets for Cas13 a/b and shRNA from RNA-seq data. Significant off-targets were calculated using FDR <0.05.
Figure 3:
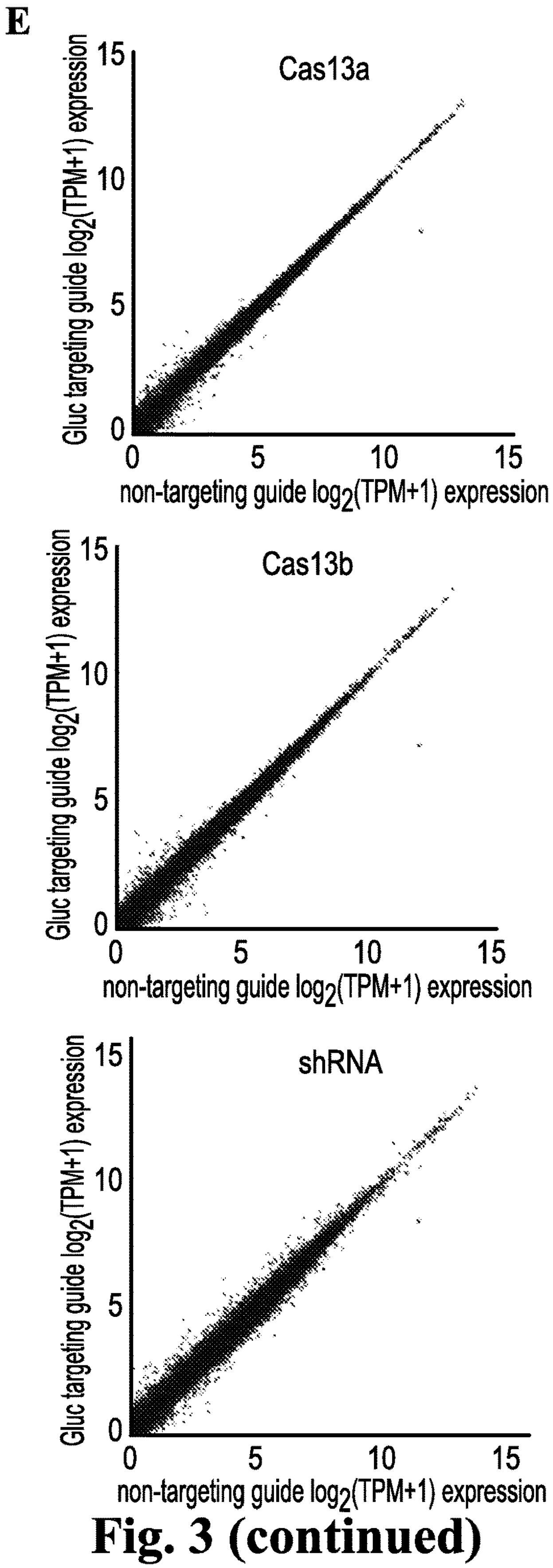
Figure 3:
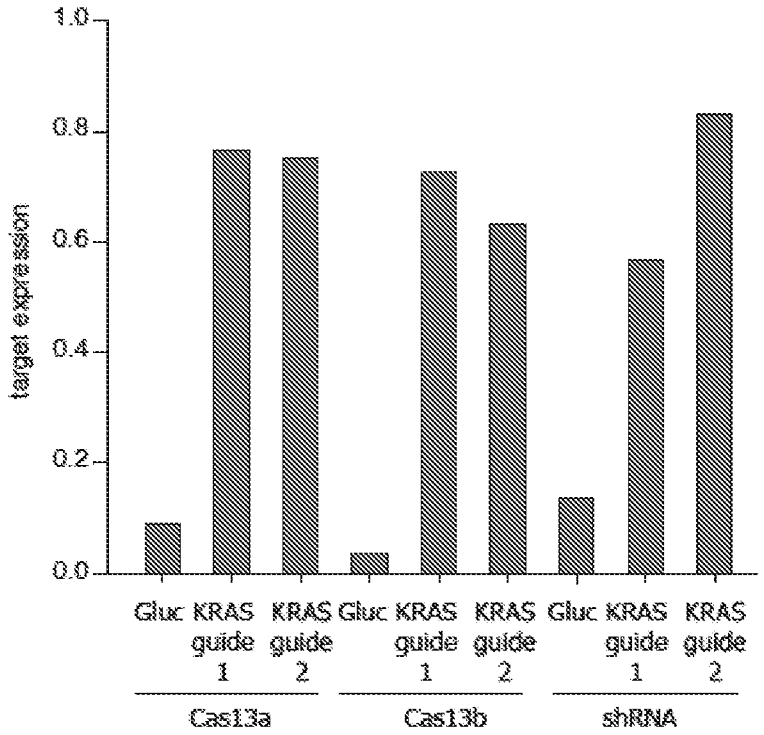
Figure 3:
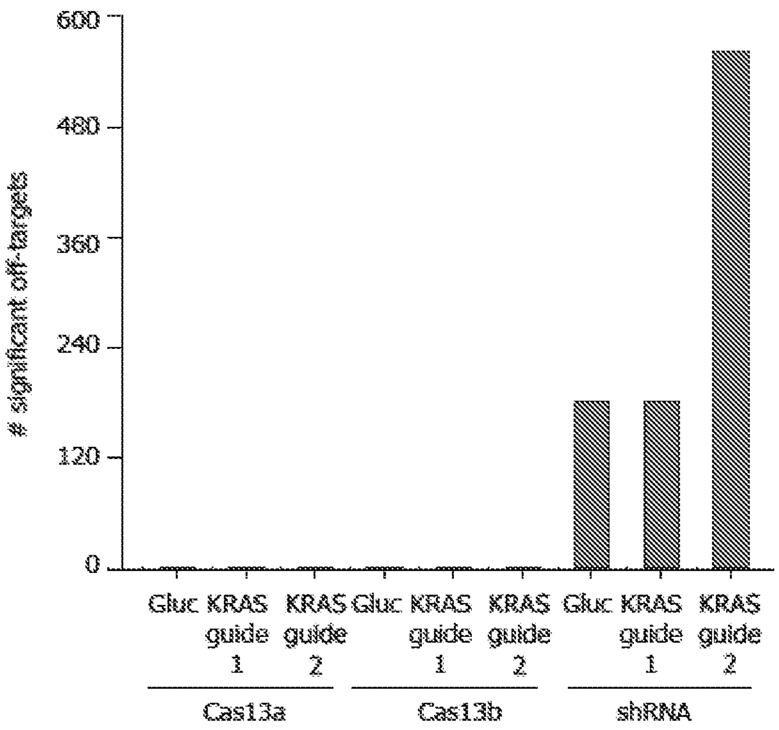
Figure 4:
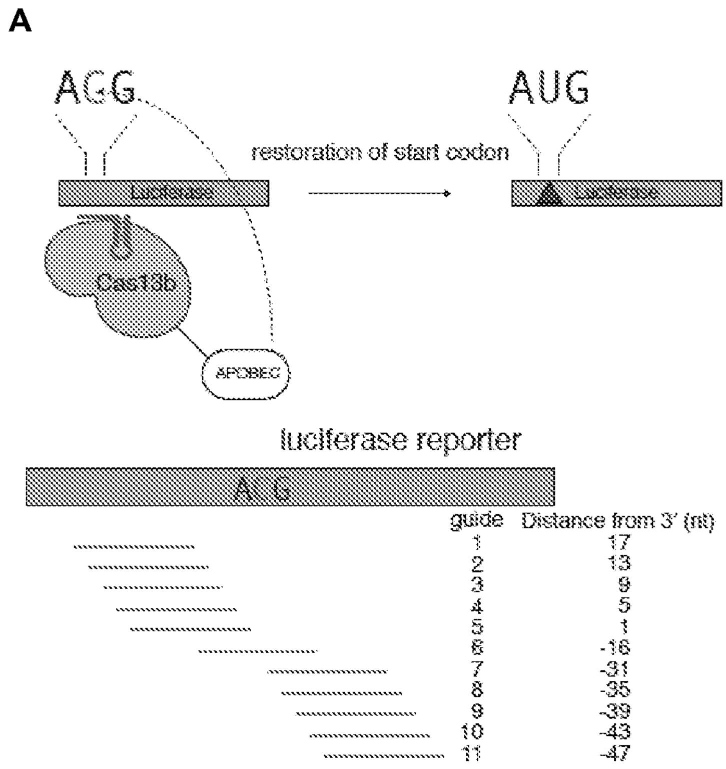
FIG. 4: Development of Cas13b-APOBEC fusions for RNA C→U editing. (A) Schematic of the luciferase assay to restore the start codon at the beginning of the Cluc transcript using Cas13b12-APOBEC fusions. (B) Guides downstream of the correction site are highly edited with the Cas13b12-APOBEC3A fusion as measured through restored luciferase activity.
Figure 4:
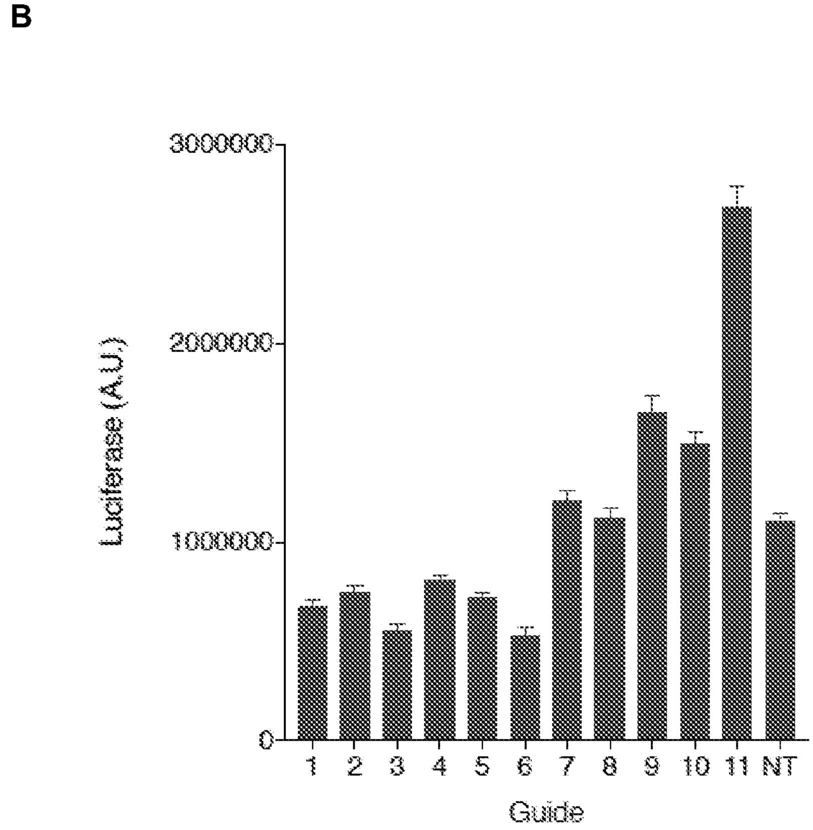

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, 4th edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboraotry Manual (1988) (Harlow and Lane, eds.): Antibodies A Laboraotry Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology $2^{nd}$ ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

Reference is made to U.S. Provisional 62/351,662 and 62/351,803, filed on Jun. 17, 2016, U.S. Provisional 62/376,377, filed on Aug. 17, 2016, U.S. Provisional 62/410,366, filed Oct. 19, 2016, U.S. Provisional 62/432,240, filed Dec. 9, 2016, U.S. provisional 62/471,792 filed Mar. 15, 2017, and U.S. Provisional 62/484,786 filed Apr. 12, 2017. Reference is made to International PCT application PCT/US2017/038154, filed Jun. 19, 2017. Reference is made to U.S. Provisional 62/471,710, filed Mar. 15, 2017 (entitled, "Novel Cas13B Orthologues CRISPR Enzymes and Systems,"). Reference is further made to U.S. Provisional 62/432,553, filed Dec. 9, 2016, U.S. Provisional 62/456,645, filed Feb. 8, 2017, and U.S. Provisional 62/471,930, filed Mar. 15, 2017 (entitled "CRISPR Effector System Based Diagnostics,") and U.S. Provisional 62/484,869, filed Apr. 12, 2017 (entitled "CRISPR Effector System Based Diagnostics,".

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

C2c2 is now known as Cas13a. It will be understood that the term "C2c2" herein is used interchangeably with "Cas13a".

All publications, published patent documents, and patent applications cited herein are hereby incorporated by reference to the same extent as though each individual publication, published patent document, or patent application was specifically and individually indicated as being incorporated by reference.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s).

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s).

Overview

The embodiments disclosed herein provide systems, constructs, and methods for targeted base editing. In general the systems disclosed herein comprise a targeting component and a base editing component. The targeting component functions to specifically target the base editing component to a target nucleotide sequence in which one or more nucleotides are to be edited. The base editing component may then catalyze a chemical reaction to convert a first nucleotide in the target sequence to a second nucleotide. For example, the base editor may catalyze conversion of an adenine such that it is read as guanine, or vice versa, or conversion of cytidine to a uracil, or vice versa. In certain example embodiments, the base editor may be derived by starting with a known base editor, such as adenine deaminase or cytodine deaminase, and using methods such as directed evolution to derive new functionalities. Directed evolution techniques are known in the art and may include those described in WO 2015/184016 “High-Throughput Assembly of Genetic Permuatations.”

In one aspect the present invention provides methods for targeted deamination of cytosine in a target RNA. According to the methods of the invention, the cytidine deaminase (CD) protein is recruited specifically to the relevant Cytosine in the target RNA by a CRISPR-Cas complex which can specifically bind to a target sequence. In order to achieve this, the cytidine deaminase protein can either be covalently linked to the CRISPR-Cas enzyme or be provided as a separate protein, but adapted so as to ensure recruitment thereof to the CRISPR-Cas complex.

In particular embodiments, of the methods of the present invention, recruitment of the cytidine deaminase to the target RNA is ensured by fusing the cytidine deaminase or catalytic domain thereof to the CRISPR-Cas protein, which is a Cas13 protein. Methods of generating a fusion protein from two separate proteins are known in the art and typically involve the use of spacers or linkers. The Cas13 protein can be fused to the cytidine deaminase protein or catalytic domain thereof on either the N- or C-terminal end thereof. In particular embodiments, the CRISPR-Cas protein is a Cas protein and is linked to the N-terminus of the deaminase protein or its catalytic domain.

The term “linker” as used in reference to a fusion protein refers to a molecule which joins the proteins to form a fusion protein. Generally, such molecules have no specific biological activity other than to join or to preserve some minimum distance or other spatial relationship between the proteins. However, in certain embodiments, the linker may be selected to influence some property of the linker and/or the fusion protein such as the folding, net charge, or hydrophobicity of the linker.

Suitable linkers for use in the methods of the present invention are well known to those of skill in the art and include, but are not limited to, straight or branched-chain carbon linkers, heterocyclic carbon linkers, or peptide linkers. However, as used herein the linker may also be a covalent bond (carbon-carbon bond or carbon-heteroatom bond). In particular embodiments, the linker is used to separate the CRISPR-Cas protein and the cytidine deaminase by a distance sufficient to ensure that each protein retains its required functional property. Preferred peptide linker sequences adopt a flexible extended conformation and do not exhibit a propensity for developing an ordered secondary structure. In certain embodiments, the linker can be a chemical moiety which can be monomeric, dimeric, multimeric or polymeric. Preferably, the linker comprises amino acids. Typical amino acids in flexible linkers include Gly, Asn and Ser. Accordingly, in particular embodiments, the linker comprises a combination of one or more of Gly, Asn and Ser amino acids. Other near neutral amino acids, such as Thr and Ala, also may be used in the linker sequence. Exemplary linkers are disclosed in Maratea et al. (1985), Gene 40:39-46; Murphy et al. (1986) Proc. Nat'l. Acad. Sci. USA 83:8258-62; U.S. Pat. Nos. 4,935,233; and 4,751,180. For example, GlySer linkers GGS, GGGS or GSG can be used. GGS, GSG, GGGS or GGGGS (SEQ ID NO: 39) linkers can be used in repeats of 3 (such as (GGS)3 (SEQ ID NO: 37), (GGGGS)3) (SEQ ID NO: 1) or 5, 6, 7, 9 or even 12 (SEQ ID NOS: 3, 4, 5, 7 or 38) or more, to provide suitable lengths. In particular embodiments, linkers such as $(GGGGS)_3$) (SEQ ID NO: 1) are preferably used herein. $(GGGGS)_6$, $(GGGGS)_9$, or $(GGGGS)_{12}$) (SEQ ID NOS: 4, 7 or 38) may preferably be used as alternatives. Other preferred alternatives are $(GGGGS)_1$, $(GGGGS)_2$, $(GGGGS)_4$, $(GGGGS)_5$, $(GGGGS)_7$, $(GGGGS)_8$, $(GGGGS)_{10}$, or $(GGGGS)_{11}$ (SEQ ID Nos. 39, 40, 2, 3, 5, 6, 8 or 9). In yet a further embodiment, LEPGEKPYKCPECGKSFSQSGALTRHQRTHTR (SEQ ID NO:11) is used as a linker. In yet an additional embodiment, the linker is XTEN linker (SEQ ID NO: 66). In particular embodiments, the CRISPR-cas protein is a Cas13 protein and is linked to the deaminase protein or its catalytic domain by means of an LEPGEKPYKCPECGKSFSQSGALTRHQRTHTR (SEQ ID NO:11) linker. In further particular embodiments, the Cas13 protein is linked C-terminally to the N-terminus of a deaminase protein or its catalytic domain by means of an LEPGEKPYKCPECGKSFSQSGALTRHQRTHTR (SEQ ID NO:11) linker. In addition, N- and C-terminal NLSs can also function as linker (e.g., PKKKRKVEASSPKKRKVEAS (SEQ ID NO: 1)).

In particular embodiments of the methods of the present invention, the cytidine deaminase protein or catalytic domain thereof is delivered to the cell or expressed within the cell as a separate protein, but is modified so as to be able to link to either the Cas13 protein or the guide molecule. In particular embodiments, this is ensured by the use of orthogonal RNA-binding protein or adaptor protein/aptamer combinations that exist within the diversity of bacteriophage coat proteins. Examples of such coat proteins include but are not limited to: MS2, Qβ, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s and PRR1. Aptamers can be naturally occurring or synthetic oligonucleotides that have been engineered through repeated rounds of in vitro selection or SELEX (systematic evolution of ligands by exponential enrichment) to bind to a specific target.

In particular embodiments of the methods and systems of the present invention, the guide molecule is provided with one or more distinct RNA loop(s) or disctinct sequence(s) that can recruit an adaptor protein. A guide molecule may be extended, without colliding with the Cas13 protein by the insertion of distinct RNA loop(s) or disctinct sequence(s) that may recruit adaptor proteins that can bind to the distinct RNA loop(s) or distinct sequence(s). Examples of modified guides and their use in recruiting effector domains to the CRISPR-Cas complex are provided in Konermann (Nature 2015, 517(7536): 583-588). In particular embodiments, the aptamer is a minimal hairpin aptamer which selectively binds dimerized MS2 bacteriophage coat proteins in mammalian cells and is introduced into the guide molecule, such as in the stemloop and/or in a tetraloop. In these embodiments, the cytidine deaminase protein is fused to MS2. The cytidine deaminase protein is then co-delivered together with the CRISPR-Cas protein and corresponding guide RNA.

The term “CD-functionalized CRISPR system” as used here refers to a nucleic acid targeting and editing system comprising (a) a CRISPR-Cas protein, more particularly a Cas13 protein which is catalytically inactive or a nickase; (b) a guide molecule which comprises a guide sequence; and (c) a cytidine deaminase protein or catalytic domain thereof; wherein the cytidine deaminase protein or catalytic domain thereof is covalently or non-covalently linked to the CRISPR-Cas protein or the guide molecule or is adapted to link thereto after delivery; wherein said guide molecule forms a complex with said catalytically inactive Cas13 and directs said complex to bind said target RNA, wherein said guide sequence is capable of hybridizing with a target sequence within said target RNA to form an RNA duplex; wherein: (A) said Cytosine is outside said target sequence that forms said RNA duplex, wherein said cytidine deaminase protein or catalytic domain thereof deaminates said Cytosine outside said RNA duplex, or (B) said Cytosine is within said target sequence that forms said RNA duplex, wherein said guide sequence comprises a non-pairing Adenine or Uracil at a position corresponding to said Cytosine resulting in a C-A or C-U mismatch in said RNA duplex, and wherein the cytidine deaminase protein or catalytic domain thereof deaminates the Cytosine in the RNA duplex opposite to the non-pairing Adenine or Uracil. In particular embodiments, the guide sequence further comprises at least one additional mismatch or non-pairing nucleotide with the target sequence, adjacent to said non-pairing Adenine or Uracil. This results in a region of single strand RNA at the location of the Cytosine of interest in the target strand, allowing the cytidine deaminase to act specifically thereon. In some embodiments, the guide sequence of the guide molecule comprises at least one further mismatch or non-pairing nucleotide with the target sequence, adjacent to said non-pairing Adenine or Uracil. In some embodiments, the guide sequence comprises a stretch of three to five consecutive mismatches with the target sequence. In some embodiments the guide sequence comprises less than 8 consecutive mismatches with the target sequence. In some embodiments, the guide sequence comprises one or more mismatches 3' and one or more mismatches 5' of the non-pairing Adenine or Uracil. In particular embodiments, the guide sequence comprises one, two three or four mismatches with the target sequence on each side of the non-pairing Adenine of Uracil. Details on the aspect of the guide of the CD-functionalized CRISPR-Cas system are provided herein below.

In some embodiments, the components (a), (b) and (c) are delivered to the cell as a ribonucleoprotein complex. The ribonucleoprotein complex can be delivered via one or more lipid nanoparticles.

In some embodiments, the components (a), (b) and (c) are delivered to the cell as one or more RNA molecules, such as one or more guide RNAs and one or more mRNA molecules encoding the CRISPR-Cas protein, the cytidine deaminase protein, and optionally the adaptor protein. The RNA molecules can be delivered via one or more lipid nanoparticles.

In some embodiments, the components (a), (b) and (c) are delivered to the cell as one or more DNA molecules. In some embodiments, the one or more DNA molecules are comprised within one or more vectors such as viral vectors (e.g., AAV). In some embodiments, the one or more DNA molecules comprise one or more regulatory elements operably configured to express the CRISPR-Cas protein, the guide molecule, and the cytidine deaminase protein or catalytic domain thereof, optionally wherein the one or more regulatory elements comprise inducible promoters. For application in eukaryotic cells, the Cas13 protein and/or the cytidine deaminase can be NES-tagged.

In some embodiments, the CRISPR-Cas protein is a catalytically inactive Cas13. In some embodiments, the catalytically inactive Cas13 comprises a mutation in the HEPN domain. In some embodiments, the catalytically inactive Cas13 has at least part of the HEPN domain removed. Details on the aspect of the CRISPR-Cas protein in the CD-functionalized CRISPR-Cas system are provided herein elsewhere.

In some embodiments of the guide molecule is capable of hybridizing with a target sequence comprising the C to be deaminated within the target RNA to form a RNA duplex which comprises a non-pairing A or U opposite to said C, optionally within a stretch of up to 5, 6, 7 or 8 mismatching nucleotides. Upon RNA duplex formation, the guide molecule forms a complex with the Cas13 protein and directs the complex to bind the target RNA, allowing the targeted C to be deaminased by the CD. Details on the aspect of the guide of the CD-functionalized CRISPR-Cas system are provided herein below.

In some embodiments, a Cas13 guide RNA having a canonical length (e.g., about 15-30 nt) is used to form a RNA duplex with the target RNA. In some embodiments, a Cas13 guide molecule longer than the canonical length (e.g., >30 nt) is used to form a RNA duplex with the target RNA including outside of the Cas13-guide RNA-target RNA complex.

In at least a first design, the CD-functionalized CRISPR system comprises (a) a cytidine deaminase fused or linked to a CRISPR-Cas protein, wherein the CRISPR-Cas protein is catalytically inactive Cas13, and (b) a guide molecule comprising a guide sequence, optionally designed to either (A) be upstream or downstream of the Cytosine of interest or (B) introduce a C-A/U mismatch in a RNA duplex formed between the guide sequence and the target sequence. In some embodiments, the CRISPR-Cas protein and/or the cytidine deaminase are NES-tagged, on either the N- or C-terminus or both.

In at least a second design, the CD-functionalized CRISPR system comprises (a) a CRISPR-Cas protein that is catalytically inactive Cas13, (b) a guide molecule comprising a guide sequence, optionally designed to either (A) be upstream or downstream of the Cytosine of interest or (B) introduce a C-A/U mismatch in a RNA duplex formed between the guide sequence and the target sequence, and an aptamer sequence (e.g., MS2 RNA motif or PP7 RNA motif) capable of binding to an adaptor protein (e.g., MS2 coating protein or PP7 coat protein), and (c) a cytidine deaminase fused or linked to an adaptor protein, wherein the binding of the aptamer and the adaptor protein recruits the cytidine deaminase to the RNA duplex formed between the guide sequence and the target sequence for targeted deamination, either at a C outside the target sequence or at the C of the optional C-A/U mismatch. In some embodiments, the adaptor protein and/or the cytidine deaminase are NES-tagged, on either the N- or C-terminus or both. The CRISPR-Cas protein can also be NES-tagged.

The use of different aptamers and corresponding adaptor proteins also allows orthogonal gene editing to be implemented. In one example in which cytidine deaminase are used in combination with adenosine deaminase for orthogonal gene editing/deamination, sgRNA targeting different loci are modified with distinct RNA loops in order to recruit MS2-adenosine deaminase and PP7-cytidine deaminase (or PP7-adenosine deaminase and MS2-cytidine deaminase), respectively, resulting in orthogonal deamination of A or C at the target RNA, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different RNAs simultaneously. For example, an sgRNA targeting RNA-A can be modified with MS2 loops, recruiting MS2-cytidine deaminase, while another sgRNA targeting RNA-B can be modified with PP7 loops, recruiting PP7-adenosine deaminase. In the same cell, orthogonal, locus-specific modifications are thus realized. This principle can be extended to incorporate other orthogonal RNA-binding proteins.

In at least a third design, the CD-functionalized CRISPR system comprises (a) a cytidine deaminase inserted into an internal loop or unstructured region of a CRISPR-Cas protein, wherein the CRISPR-Cas protein is catalytically inactive Cas13, and (b) a guide molecule comprising a guide sequence, optionally designed to either (A) be upstream or downstream of the Cytosine of interest or (B) introduce a C-A/U mismatch in a RNA duplex formed between the guide sequence and the target sequence.

CRISPR-Cas protein split sites that are suitable for inseration of cytidine deaminase can be identified with the help of a crystal structure. One can use the crystal structure of an ortholog if a relatively high degree of homology exists between the ortholog and the intended CRISPR-Cas protein.

The split position may be located within a region or loop. Preferably, the split position occurs where an interruption of the amino acid sequence does not result in the partial or full destruction of a structural feature (e.g. alpha-helixes or β-sheets). Unstructured regions (regions that did not show up in the crystal structure because these regions are not structured enough to be "frozen" in a crystal) are often preferred options. The positions within the unstructured regions or outside loops may not need to be exactly the numbers provided above, but may vary by, for example 1, 2, 3, 4, 5, 6, 7, 8, 9, or even 10 amino acids either side of the position given above, depending on the size of the loop, so long as the split position still falls within an unstructured region of outside loop.

The CD-functionalized CRISPR system described herein can be used to target a specific Cytosine within a RNA sequence for deamination. For example, the guide molecule can form a complex with the CRISPR-Cas protein and directs the complex to bind a target sequence at the target RNA. The guide sequence can be designed to be upstream or downstreat of the Cytosine of interest, allowing the RNA duplex to form upstream or downstream of the Cytosine of interesting, such that the cytidine deaminase can contact and deaminate the C in a region of single strand RNA outside the RNA duplex. Alternatively, the guide sequence can be designed to have a non-pairing A or U with the Cytosine of interest, which in particular embodiments is extended to a stretch of non-pairing nucleotides, such that the RNA duplex formed between the guide sequence and the target sequence comprises a region of single strand RNA, which directs the cytidine deaminase to contact and deaminate the C opposite to the non-pairing A or U, converting it to an Uracil (U). Since Uracil (U) base pairs with A and functions like T in cellular process, the targeted deamination of C described herein are useful for correction of undesirable T(U)-C and A-G mutations, as well as for obtaining desirable G-A and C-T mutations.

In some embodiments, the CD-functionalized CRISPR system is used for targeted deamination in a RNA molecule in vitro. In some embodiments, the CD-functionalized CRISPR system is used for targeted deamination in a RNA molecule within a cell. The cell can be a eukaryotic cell, such as an animal cell, a mammalian cell, a human, or a plant cell.

The invention also relates to a method for treating or preventing a disease by the targeted deamination using the CD-functionalized CRISPR system, wherein the deamination of the C restores a healthy genotype at the target RNA, which remedies a disease caused by a T(U)→C or A→G point mutation or a pathogenic SNP.

The invention also relates to a method for knocking-out or knocking-down an undesirable activity of a gene or regulatory element thereof, wherein the deamination of the Cytosine at the target RNA inactivates a target gene transcript. For example, in one embodiment, the targeted deamination by the CD-functionalized CRISPR system can cause a nonsense mutation resulting in a premature translation stop codon in a target gene transcript (e.g., converting CAA, CGA or CAG to T(U) AA, T(U) GA or T(U) AG, respectively). This may alter the translation of the target gene transcript and can lead to a desirable trait in the edited cell. In another embodiment, the targeted deamination by the CD-functionalized CRISPR system can cause a nonconservative missense mutation resulting in a code for a different amino acid residue in a target gene transcript. This may alter the function of the target gene transcript expressed and can also lead to a desirable trait in the edited cell.

The invention also relates to a modified cell obtained by the targeted deamination using the CD-functionalized CRISPR system, or progeny thereof, wherein the modified cell comprises an U or T in replace of the C in the target RNA compared to a corresponding cell before the targeted deamination. The modified cell can be a eukaryotic cell, such as an animal cell, a plant cell, a mammalian cell, or a human cell.

In some embodiments, the modified cell is a therapeutic T cell, such as a T cell sutiable for CAR-T therapies. The modification may result in one or more desirable traits in the therapeutic T cell, including but not limited to, reduced expression of an immune checkpoint receptor (e.g., PDA, CTLA4), reduced expression of HLA proteins (e.g., B2M, HLA-A), and reduced expression of an endogenous TCR.

In some embodiments, the modified cell is an antibody-producing B cell. The modification may result in one or more desirable traits in the B cell, including but not limited to, enhanced antibody production.

The invention also relates to a modified non-human animal or a modified plant. The modified non-human animal can be a farm animal. The modified plant can be an agricultural crop.

The invention further relates to a method for cell therapy, comprising administering to a patient in need thereof the modified cell described herein, wherein the presence of the modified cell remedies a disease in the patient. In one embodiment, the modified cell for cell therapy is a CAR-T cell capable of recognizing and/or attacking a tumor cell. In another embodiment, the modified cell for cell therapy is a stem cell, such as a neural stem cell, a mesenchymal stem cell, a hematopoietic stem cell, or an iPSC cell.

The invention additionally relates to an engineered, non-naturally occurring system suitable for modifying an Cytosine in a target RNA, comprising: a guide molecule which comprises a guide sequence, or a nucleotide sequence encoding the guide molecule; a CRISPR-Cas protein, or one or more nucleotide sequences encoding the CRISPR-Cas protein; a cytidine deaminase protein or catalytic domain thereof, or one or more nucleotide sequences encoding; wherein the cytidine deaminase protein or catalytic domain thereof is covalently or non-covalently linked to the CRISPR-Cas protein or the guide molecule or is adapted to link thereto after delivery; wherein said guide sequence is capable of hybridizing with a target sequence within said target RNA to form an RNA duplex; wherein: (A) said Cytosine is outside said target sequence that forms said RNA duplex, or (B) said Cytosine is within said target sequence that forms said RNA duplex and wherein said guide sequence comprises a non-pairing Adenine or Uracil at a position corresponding to said Cytosine resulting in a C-A or C-U mismatch in said RNA duplex.

The invention additionally relates to an engineered, non-naturally occurring vector system suitable for modifying an Cytosine in a target RNA, comprising one or more vectors comprising: a first regulatory element operably linked to one or more nucleotide sequences encoding a guide molecule which comprises a guide sequence; a second regulatory element operably linked to a nucleotide sequence encoding a CRISPR-Cas protein; and optionally a nucleotide sequence encoding a cytidine deaminase protein protein or catalytic domain thereof which is under control of the first or second regulatory element or operably linked to a third regulatory element; wherein, if the nucleotide sequence encoding a cytidine deaminase protein or catalytic domain thereof is operably linked to a third regulatory element, the cytidine deaminase protein or catalytic domain thereof is adapted to link to the guide molecule or the Crispr-Cas protein after expression; wherein components (a), (b) and (c) are located on the same or different vectors of the system.

The invention additionally relates to in vitro, ex vivo or in vivo host cell or cell line or progeny thereof comprising the engineered, non-naturally occurring system or vector system described herein. The host cell can be a eukaryotic cell, such as an animal cell, a plant cell, a mammalian cell, or a human cell.

Cytidine Deaminase

The term "cytidine deaminase" or "cytidine deaminase protein" as used herein refers to a protein, a polypeptide, or one or more functional domain(s) of a protein or a polypeptide that is capable of catalyzing a hydrolytic deamination reaction that converts an cytosine (or an cytosine moiety of a molecule) to an uracil (or a uracil moiety of a molecule), as shown below. In some embodiments, the cytosine-containing molecule is an cytidine (C), and the uracil-containing molecule is an uridine (U). The cytosine-containing molecule can be deoxyribonucleic acid (DNA) or ribonucleic acid (RNA).

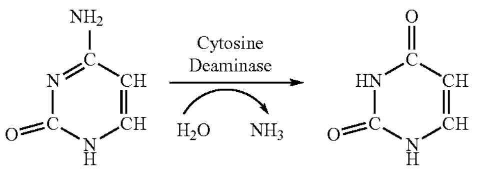

Cytosine (4-amino-2-oxopyrimidine)

Uracil (2,4-dioxopyrimidine)

According to the present disclosure, cytidine deaminases that can be used in connection with the present disclosure include, but are not limited to, members of the enzyme family known as apolipoprotein B mRNA-editing complex (APOBEC) family deaminase, an activation-induced deaminase (AID), or a cytidine deaminase 1 (CDA1). In particular embodiments, the deaminase in an APOBEC1 deaminase, an APOBEC2 deaminase, an APOBEC3A deaminase, an APOBEC3B deaminase, an APOBEC3C deaminase, and APOBEC3D deaminase, an APOBEC3E deaminase, an APOBEC3F deaminase an APOBEC3G deaminase, an APOBEC3H deaminase, or an APOBEC4 deaminase.

In the methods and systems of the present invention, the cytidine deaminase is capable of targeting Cytosine in a DNA single strand. In certain example embodiments the cytodine deaminase may edit on a single strand present outside of the binding component e.g. bound Cas13. In other example embodiments, the cytodine deaminasemay edit at a localized bubble, such as a localized bubble formed by a mismatch at the target edit site but the guide sequence. In certain example embodiments the cytodine deaminase may contain mutations that help focus the are of activity such as those disclosed in Kim et al., Nature Biotechnology (2017) 35(4): 371-377 (doi: 10.1038/nbt.3803.

In some embodiments, the cytidine deaminase is derived from one or more metazoa species, including but not limited to, mammals, birds, frogs, squids, fish, flies and worms. In some embodiments, the cytidine deaminase is a human, primate, cow, dog rat or mouse cytidine deaminase.

In some embodiments, the cytidine deaminase is a human APOBEC, including hAPOBEC1 or hAPOBEC3. In some embodiments, the cytidine deaminase is a human AID.

In some embodiments, the cytidine deaminase protein recognizes and converts one or more target cytosine residue(s) in a single-stranded bubble of a RNA duplex into uracil residues(s). In some embodiments, the cytidine deaminase protein recognizes a binding window on the single-stranded bubble of a RNA duplex. In some embodiments, the binding window contains at least one target cytosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the cytidine deaminase protein comprises one or more deaminase domains. Not intended to be bound by theory, it is contemplated that the deaminase domain functions to recognize and convert one or more target cytosine (C) residue(s) contained in a single-stranded bubble of a RNA duplex into (an) uracil (U) residue(s). In some embodiments, the deaminase domain comprises an active center. In some embodiments, the active center comprises a zinc ion. In some embodiments, amino acid residues in or near the active center interact with one or more nucleotide(s) 5' to a target cytosine residue. In some embodiments, amino acid residues in or near the active center interact with one or more nucleotide(s) 3' to a target cytosine residue.

In some embodiments, the cytidine deaminase comprises human APOBEC1 full protein (hAPOBEC1) or the deaminase domain thereof (hAPOBEC1-D) or a C-terminally truncated version thereof (hAPOBEC-T). In some embodiments, the cytidine deaminase is an APOBEC family member that is homologous to hAPOBEC1, hAPOBEC-D or hAPOBEC-T. In some embodiments, the cytidine deaminase comprises human AID1 full protein (hAID) or the deaminase domain thereof (hAID-D) or a C-terminally truncated version thereof (hAID-T). In some embodiments, the cytidine deaminase is an AID family member that is homologous to hAID, hAID-D or hAID-T. In some embodiments, the hAID-T is a hAID which is C-terminally truncated by about 20 amino acids.

In some embodiments, the cytidine deaminase comprises the wild-type amino acid sequence of a cytosine deaminase. In some embodiments, the cytidine deaminase comprises one or more mutations in the cytosine deaminase sequence, such that the editing efficiency, and/or substrate editing preference of the cytosine deaminase is changed according to specific needs.

Certain mutations of APOBEC1 and APOBEC3 proteins have been described in Kim et al., Nature Biotechnology (2017) 35(4): 371-377 (doi: 10.1038/nbt.3803); and Harris et al. Mol. Cell (2002) 10:1247-1253, each of which is incorporated herein by reference in its entirety.

In some embodiments, the cytidine deaminase is an APOBEC1 deaminase comprising one or more mutations at amino acid positions corresponding to W90, R118, H121, H122, R126, or R132 in rat APOBEC1, or an APOBEC3G deaminase comprising one or more mutations at amino acid positions corresponding to W285, R313, D316, D317X, R320, or R326 in human APOBEC3G.

In some embodiments, the cytidine deaminase comprises a mutation at tryptophane$^{90}$ of the rat APOBEC1 amino acid sequence, or a corresponding position in a homologous APOBEC protein, such as tryptophane$^{285}$ of APOBEC3G. In some embodiments, the tryptophane residue at position 90 is replaced by an tyrosine or phenylalanine residue (W90Y or W90F).

In some embodiments, the cytidine deaminase comprises a mutation at Arginine$^{118}$ of the rat APOBEC1 amino acid sequence, or a corresponding position in a homologous APOBEC protein. In some embodiments, the arginine residue at position 118 is replaced by an alanine residue (R118A).

In some embodiments, the cytidine deaminase comprises a mutation at Histidine$^{121}$ of the rat APOBEC1 amino acid sequence, or a corresponding position in a homologous APOBEC protein. In some embodiments, the histidine residue at position 121 is replaced by an arginine residue (H121R).

In some embodiments, the cytidine deaminase comprises a mutation at Histidine$^{122}$ of the rat APOBEC1 amino acid sequence, or a corresponding position in a homologous APOBEC protein. In some embodiments, the histidine residue at position 122 is replaced by an arginine residue (H122R).

In some embodiments, the cytidine deaminase comprises a mutation at Arginine$^{126}$ of the rat APOBEC1 amino acid sequence, or a corresponding position in a homologous APOBEC protein, such as Arginine$^{320}$ of APOBEC3G. In some embodiments, the arginine residue at position 126 is replaced by an alanine residue (R126A) or by a glutamic acid (R126E).

In some embodiments, the cytidine deaminase comprises a mutation at arginine$^{132}$ of the APOBEC1 amino acid sequence, or a corresponding position in a homologous APOBEC protein. In some embodiments, the arginine residue at position 132 is replaced by a glutamic acid residue (R132E).

In some embodiments, to narrow the width of the editing window, the cytidine deaminase may comprise one or more of the mutations: W90Y, W90F, R126E and R132E, based on amino acid sequence positions of rat APOBEC1, and mutations in a homologous APOBEC protein corresponding to the above.

In some embodiments, to reduce editing efficiency, the cytidine deaminase may comprise one or more of the mutations: W90A, R118A, R132E, based on amino acid sequence positions of rat APOBEC1, and mutations in a homologous APOBEC protein corresponding to the above.

In particular embodiments, it can be of interest to use a cytidine deaminase enzyme with reduced efficicay to reduce off-target effects.

In some embodiments, the cytidine deaminase is wild-type rat APOBEC1 (rAPOBEC1, or a catalytic domain thereof. In some embodiments, the cytidine deaminase comprises one or more mutations in the rAPOBEC1 sequence, such that the editing efficiency, and/or substrate editing preference of rAPOBEC1 is changed according to specific needs.

```
rAPOBEC1:
                                          (SEQ ID NO: 42)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLK
```

In some embodiments, the cytidine deaminase is wild-type human APOBEC1 (hAPOBEC1) or a catalytic domain thereof. In some embodiments, the cytidine deaminase comprises one or more mutations in the hAPOBEC1 sequence, such that the editing efficiency, and/or substrate editing preference of hAPOBEC1 is changed according to specific needs.

```
APOBEC1:
                                          (SEQ ID NO: 43)
MTSEKGPSTGDPTLRRRIEPWEFDVFYDPRELRKEACLLYEIKWGMSRKI

WRSSGKNTTNHVEVNFIKKFTSERDFHPSMSCSITWFLSWSPCWECSQAI

REFLSRHPGVTLVIYVARLFWHMDQQNRQGLRDLVNSGVTIQIMRASEYY

HCWRNFVNYPPGDEAHWPQYPPLWMMLYALELHCIILSLPPCLKISRRWQ

NHLTFFRLHLQNCHYQTIPPHILLATGLIHPSVAWR
```

In some embodiments, the cytidine deaminase is wild-type human APOBEC3G (hAPOBEC3G) or a catalytic domain thereof. In some embodiments, the cytidine deaminase comprises one or more mutations in the hAPOBEC3G sequence, such that the editing efficiency, and/or substrate editing preference of hAPOBEC3G is changed according to specific needs.

```
hAPOBEC3G:
                                          (SEQ ID NO: 44)
MELKYHPEMRFFHWFSKWRKLHRDQEYEVTWYISWSPCTKCTRDMATFLA

EDPKVTLTIFVARLYYFWDPDYQEALRSLCQKRDGPRATMKIMNYDEFQH

CWSKFVYSQRELFEPWNNLPKYYILLHIMLGEILRHSMDPPTFTFNFNNE

PWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCI

FTARIYDDQGRCQEGLRTLAEAGAKISIMTYSEFKHCWDTFVDHQGCPFQ

PWDGLDEHSQDLSGRLRAILQNQEN
```

In some embodiments, the cytidine deaminase is wild-type *Petromyzon marinus* CDA1 (pmCDA1) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

pmCDA1:

(SEQ ID NO: 45)
MTDAEYVRIHEKLDIYTFKKQFFNNKKSVSHRCYVLFELKRRGERRACFW

GYAVNKPQSGTERGIHAEIFSIRKVEEYLRDNPGQFTINWYSSWSPCADC

AEKILEWYNQELRGNGHTLKIWACKLYYEKNARNQIGLWNLRDNGVGLNV

MVSEHYQCCRKIFIQSSHNQLNENRWLEKTLKRAEKRRSELSIMIQVKIL

HTTKSPAV

In some embodiments, the cytidine deaminase is wild-type human AID (hAID) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

hAID:

(SEQ ID NO: 46)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPYLSLRIFTARLYFCEDRKAEPEGLRRLHRAGVQIAIMTFKDYFYCWNT

FVENHERTFKAWEGLHENSVRLSRQLRRILLPLYEVDDLRDAFRTLGLLD

In some embodiments, the cytidine deaminase is truncated version of hAID (hAID-DC) or a catalytic domain thereof. In some embodiments, the cytidine deaminase comprises one or more mutations in the hAID-DC sequence, such that the editing efficiency, and/or substrate editing preference of hAID-DC is changed according to specific needs.

hAID-DC:

(SEQ ID NO: 47)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPNLSLRIFTARLYFCEDRKAEPEGLRRLHRAGVQIAIMTFKDYFYCWNT

FVENHERTFKAWEGLHENSVRLSRQLRRILL

Additional embodiments of the cytidine deaminase are disclosed in WO WO2017/070632, titled "Nucleobase Editor and Uses Thereof," which is incorporated herein by reference in its entirety.

In some embodiments, the cytidine deaminase has an efficient deamination window that encloses the nucleotides susceptible to deamination editing. Accordingly, in some embodiments, the "editing window width" refers to the number of nucleotide positions at a given target site for which editing efficiency of the cytidine deaminase exceeds the half-maximal value for that target site. In some embodiments, the cytidine deaminase has an editing window width in the range of about 1 to about 6 nucleotides. In some embodiments, the editing window width of the cytidine deaminase is 1, 2, 3, 4, 5, or 6 nucleotides.

Not intended to be bound by theory, it is contemplated that in some embodiments, the length of the linker sequence affects the editing window width. In some embodiments, the editing window width increases (e.g., from about 3 to about 6 nucleotides) as the linker length extends (e.g., from about 3 to about 21 amino acids). In a non-limiting example, a 16-residue linker offers an efficient deamination window of about 5 nucleotides. In some embodiments, the length of the guide RNA affects the editing window width. In some embodiments, shortening the guide RNA leads to a narrowed efficient deamination window of the cytidine deaminase.

In some embodiments, mutations to the cytidine deaminase affect the editing window width. In some embodiments, the cytidine deaminase component of the CD-functionalized CRISPR system comprises one or more mutations that reduce the catalytic efficiency of the cytidine deaminase, such that the deaminase is prevented from deamination of multiple cytidines per DNA binding event. In some embodiments, tryptophan at residue 90 (W90) of APOBEC1 or a corresponding tryptophan residue in a homologous sequence is mutated. In some embodiments, the catalytically inactive Cas13 is fused to or linked to an APOBEC1 mutant that comprises a W90Y or W90F mutation. In some embodiments, tryptophan at residue 285 (W285) of APOBEC3G, or a corresponding tryptophan residue in a homologous sequence is mutated. In some embodiments, the catalytically inactive Cas13 is fused to or linked to an APOBEC3G mutant that comprises a W285Y or W285F mutation.

In some embodiments, the cytidine deaminase component of CD-functionalized CRISPR system comprises one or more mutations that reduce tolerance for non-optimal presentation of a cytidine to the deaminase active site. In some embodiments, the cytidine deaminase comprises one or more mutations that alter substrate binding activity of the deaminase active site. In some embodiments, the cytidine deaminase comprises one or more mutations that alter the conformation of DNA to be recognized and bound by the deaminase active site. In some embodiments, the cytidine deaminase comprises one or more mutations that alter the substrate accessibility to the deaminase active site. In some embodiments, arginine at residue 126 (R126) of APOBEC1 or a corresponding arginine residue in a homologous sequence is mutated. In some embodiments, the catalytically inactive Cas13 is fused to or linked to an APOBEC1 that comprises a R126A or R126E mutation. In some embodiments, tryptophan at residue 320 (R320) of APOBEC3G, or a corresponding arginine residue in a homologous sequence is mutated. In some embodiments, the catalytically inactive Cas13 is fused to or linked to an APOBEC3G mutant that comprises a R320A or R320E mutation. In some embodiments, arginine at residue 132 (R132) of APOBEC1 or a corresponding arginine residue in a homologous sequence is mutated. In some embodiments, the catalytically inactive Cas13 is fused to or linked to an APOBEC1 mutant that comprises a R132E mutation.

In some embodiments, the APOBEC1 domain of the CD-functionalized CRISPR system comprises one, two, or three mutations selected from W90Y, W90F, R126A, R126E, and R132E. In some embodiments, the APOBEC1 domain comprises double mutations of W90Y and R126E. In some embodiments, the APOBEC1 domain comprises double mutations of W90Y and R132E. In some embodiments, the APOBEC1 domain comprises double mutations of R126E and R132E. In some embodiments, the APOBEC1 domain comprises three mutations of W90Y, R126E and R132E.

In some embodiments, one or more mutations in the cytidine deaminase as disclosed herein reduce the editing window width to about 2 nucleotides. In some embodiments, one or more mutations in the cytidine deaminase as disclosed herein reduce the editing window width to about 1 nucleotide. In some embodiments, one or more mutations in the cytidine deaminase as disclosed herein reduce the editing window width while only minimally or modestly affecting the editing efficiency of the enzyme. In some embodiments, one or more mutations in the cytidine deaminase as disclosed herein reduce the editing window width without reducing the editing efficiency of the enzyme. In some embodiments, one or more mutations in the cytidine deaminase as disclosed herein enable discrimination of neighboring cytidine nucleotides, which would be otherwise edited with similar efficiency by the cytidine deaminase.

In some embodiments, the cytidine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the cytidine deaminase and the substrate is mediated by one or more additional protein factor(s), including a CRISPR/CAS protein factor. In some embodiments, the interaction between the cytidine deaminase and the substrate is further mediated by one or more nucleic acid component(s), including a guide RNA.

According to the present invention, the substrate of the cytidine deaminase is an DNA single strand bubble of a RNA duplex comprising a Cytosine of interest, made accessible to the cytidine deaminase upon binding of the guide molecule to its DNA target which then forms the CRISPR-Cas complex with the CRISPR-Cas enzyme, whereby the cytosine deaminase is fused to or is capable of binding to one or more components of the CRISPR-Cas complex, i.e. the CRISPR-Cas enzyme and/or the guide molecule. The particular features of the guide molecule and CRISPR-Cas enzyme are detailed below.

Targeting Domain

The methods, tools, and compositions of the invention comprise or make use of a targeting component which can be referred to as a targeting domain. The targeting domain is preferably a RNA targeting domain, more particularly an oligonucleotide targeting domain, or a variant or fragment theofe which retains RNA binding activity. The oligonucleotide targeting domain may bind a sequence, motif, or structural feature of the RNA of interest at or adjacent to the target locus. A structural feature may include hairpins, tetraloops, or other secondary structural features of a nucleic acid. As used herein “adjacent” means within a distance and/or orientation of the target locus in which the adenosine deaminase can complete its base editing function. In certain example embodiments, the oligonucleotide binding protein may be a RNA-binding protein or functional domain thereof.

In particular embodiments, the targeting domain further comprises a guide RNA (as will be detailed below). The nucleic acid binding protein can be an (endo) nuclease or any other (oligo) nucleotide binding protein. In particular embodiments, the nucleotide binding protein is modified to inactivate any other function not required for said RNA binding. In particular embodiments, where the nucleotide binding protein is an (endo) nuclease, preferably the (endo) nuclease has altered or modified activity (i.e. a modified nuclease, as described herein elsewhere) compared to the wildtype RNA binding protein. In certain embodiments, said nuclease is a targeted or site-specific or homing nuclease or a variant thereof having altered or modified activity. In certain embodiments, said (oligo) nucleotide binding protein is the (oligo) nucleotide binding domain of said (oligo) nucleotide binding protein and does not comprise one or more domains of said protein not required for RNA binding (more particular does not comprise one or more other functional domains).

RNA-Binding Proteins

In certain example embodiments, the oligonucleotide binding domain may comprise or consist of a RNA-binding protein, or functional domain thereof, that comprises a RNA recognition motif. Example RNA-binding proteins comprising a RNA recognition motif include, but are not limited to, A2BP1; ACF; BOLL; BRUNOL4; BRUNOL5; BRUNOL6; CCBL2; CGI96; CIRBP; CNOT4; CPEB2; CPEB3; CPEB4; CPSF7; CSTF2; CSTF2T; CUGBP1; CUGBP2; D10S102; DAZ1; DA Z2; DAZ3; DAZ4; DAZAP1; DAZL; DNAJC17; DND1; EIF3S4; EIF3S9; EIF4B; EIF4H; ELA VL1; ELAVL2; ELAVL3; ELAVL4; ENOX1; ENOX2; EWSR1; FUS; FUSIP1; G3BP; G3BP1; G3BP2; GRSF1; HNRNPL; HNRPA0; HNRPA1; HNRPA2B1; HNRPA3; HNRPAB; HNRPC; HNRPCL1; HNRPD; HNRPDL; HNRPF; HNRPH1; HNRPH2; HNRPH3; HNRPL; HNR-PLL; HNRPM; HNRPR; HRNBP1; HSU53209; HTATSF1; IGF2BP1; IGF2BP2; IGF2BP3; LARP7; MKI67IP; MSI1; MSI2; MSSP2; MTHFSD; MYEF2; NCBP2; NCL; NOL8; NONO; P14; PAB PC1; PABPCIL; PABPC3; PABPC4; PABPC5; PABPN1; POLDIP3; PPARGC1; PPARGCIA; PPARGC1B; PPIE; PPIL4; PPRC1; PSPC1; PTBP1; PTBP2; PUF60; RALY; RALYL; RAVER 1; RAVER2; RBM10; RBM11; RBM12; RBM12B; RBM14; RBM15; RBM15B; RBM16; RB M17; RBM18; RBM19; RBM22; RBM23; RBM24; RBM25; RBM26; RBM27; RBM28; RBM3; RBM32B; RBM33; RBM34; RBM35A; RBM35B; RBM38; RBM39; RBM4; RBM41; RBM4 2; RBM44; RBM45; RBM46; RBM47; RBM4B; RBM5; RBM7; RBM8A; RBM9; RBMS1; RB MS2; RBMS3; RBMX; RBMX2; RBMXL2; RBMY1A1; RBMY1B; RBMY1E; RBMYIF; RB MY2FP; RBPMS; RBPMS2; RDBP; RNPC3; RNPC4; RNPS1; ROD1; SAFB; SAFB2; SART3; SETDIA; SF3B14; SF3B4; SFPQ; SFRS1; SFRS10; SFRS11; SFRS12; SFRS15; SFRS2; SFR S2B; SFRS3; SFRS4; SFRS5; SFRS6; SFRS7; SFRS9; SLIRP; SLTM; SNRP70; SNRPA; SNR PB2; SPEN; SR140; SRRP35; SSB; SYNCRIP; TAF15; TARDBP; THOC4; TIA1; TIAL1; TN RC4; TNRC6C; TRA2A; TRSPAP1; TUT1; UIS-NRNPBP; U2AF1; U2AF2; UHMK1; ZCRB1; ZNF638; ZRSR1; and ZRSR2.

In certain example embodiments, the RNA-binding protein or function domain thereof may comprise a K homology domain. Example RNA-binding proteins comprising a K homology domain include, but are not limited to, AKAP1; ANKHD1; ANKRD17; ASCC1; BICC1; DDX43; DDX53; DPPA5; FMR1; FUBP1; F UBP3; FXR1; FXR2; GLD1; HDLBP; HNRPK; IGF2BP1; IGF2BP2; IGF2BP3; KHDRBS1; K HDRBS2; KHDRBS3; KHSRP; KRR1; MEX3A; MEX3B; MEX3C; MEX3D; NOVA1; NOVA 2; PCBP1; PCBP2; PCBP3; PCBP4; PNO1; PNPT1; QKI; SF1; and TDRKH In certain example embodiments, the RNA-binding protein comprises a zinc finger motif. RNA-binding proteins or functional domains thereof may comprise a Cys2-His2, Gag-knuckle, Treble-clet, Zinc ribbon, Zn2/Cys6 class motif.

In certain example embodiments, the RNA-binding protein may comprise a *Pumilio* homology domain.

CRISPR-Cas Protein and Guide

In the methods and systems of the present invention use is made of a CRISPR-Cas protein and corresponding guide molecule. In certain embodiments, said CRISPR-Cas protein Cas13a/C2c2, Cas13b, or Cas13c. The CRISPR-Cas system does not require the generation of customized proteins to target specific sequences but rather a single Cas protein can be programmed by guide molecule to recognize a specific nucleic acid target, in other words the Cas enzyme protein can be recruited to a specific nucleic acid target RNA using said guide molecule.

Guide Molecule

The guide molecule or guide RNA of a Class 2 type V CRISPR-Cas protein comprises a tracr-mate sequence (encompassing a "direct repeat" in the context of an endogenous CRISPR system) and a guide sequence (also referred to as a "spacer" in the context of an endogenous CRISPR system). Indeed, in contrast to the type II CRISPR-Cas proteins, the Cas13 protein does not rely on the presence of a tracr sequence. In some embodiments, the CRISPR-Cas system or complex as described herein does not comprise and/or does not rely on the presence of a tracr sequence (e.g. if the Cas protein is Cas13). In certain embodiments, the guide molecule may comprise, consist essentially of, or consist of a direct repeat sequence fused or linked to a guide sequence or spacer sequence.

In general, a CRISPR system is characterized by elements that promote the formation of a CRISPR complex at the site of a target sequence. In the context of formation of a CRISPR complex, "target sequence" refers to a sequence to which a guide sequence is designed to have complementarity, where hybridization between a target RNA sequence and a guide sequence promotes the formation of a CRISPR complex.

The terms "guide molecule" and "guide RNA" are used interchangeably herein to refer to RNA-based molecules that are capable of forming a complex with a CRISPR-Cas protein and comprises a guide sequence having sufficient complementarity with a target nucleic acid sequence to hybridize with the target nucleic acid sequence and direct sequence-specific binding of the complex to the target nucleic acid sequence. The guide molecule or guide RNA specifically encompasses RNA-based molecules having one or more chemically modifications (e.g., by chemical linking two ribonucleotides or by replacement of one or more ribonucleotides with one or more deoxyribonucleotides), as described herein.

In some embodiments, the C-U/A mismatch corresponding to the target site of interest is located close to the center of the target sequence and thus the center of the guide sequence, thereby restricting the cytidine deaminase to a narrow editing window (e.g., about 4 bp wide). In some embodiments, the target sequence may comprise more than one target cytosine to be deaminated. In further embodiments the target sequence may further comprise one or more cytosines to be deaminated 3' to the target cytosine site. In these embodiments, further C-U/A mismatches can be provided in the guide sequence. Depending on their location within the target sequence, these may be located within the same or a separate stretch of mismatching or non-pairing nucleotides in the guide sequence. In some embodiments, to avoid off-target editing, the target sequence does not have further mismatched cytosines within the target sequence.

In some embodiments, a Cas13 guide sequence having a canonical length (e.g., about 15-30 nt) is used to hybridize with the target RNA. In some embodiments, a Cas13 guide molecule longer than the canonical length (e.g., >30 nt) is used to hybridize with the target RNA, such that a region of the guide sequence hybridizes with a region of the RNA strand outside of the Cas13-guide RNA-target RNA complex. This can be of interest where deamination of more than one cytosine within a given stretch of nucleotides is of interest. In alternative embodiments, it is of interest to maintain the limitation of the canonical guide sequence length. In some embodiments, the guide sequence is designed to introduce a C-U/A mismatch outside of the canonical length of Cas13 guide, distant from the PAM sequence, which may decrease steric hindrance by Cas13 and increase the frequency of contact between the cytidine deaminase and the C-U/A mismatch.

As used herein, the term "crRNA" or "guide RNA" or "single guide RNA" or "sgRNA" or "one or more nucleic acid components" of a Type V or Type VI CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, the guide molecule comprises a guide sequence that is designed to have at least one mismatch with the taret sequence, such that an RNA duplex formed between the guide sequence and the target sequence comprises a non-pairing C in the guide sequence opposite to the target A for deamination on the target sequence. In some embodiments, aside from this A-C mismatch, the degree of complementarity, when optimally aligned using a suitable alignment algorithm, is about or more than about 50%, 60%, 75%, 80%, 85%, 90%, 95%, 97.5%, 99%, or more.

As used herein, the term "crRNA" or "guide RNA" or "single guide RNA" or "sgRNA" or "one or more nucleic acid components" of a Type V or Type VI CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

The "tracrRNA" sequence or analogous terms includes any polynucleotide sequence that has sufficient complementarity with a crRNA sequence to hybridize. In some embodiments, the degree of complementarity between the tracrRNA sequence and crRNA sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and crRNA sequence are contained within a single transcript, such that hybridization between the two produces a transcript having a secondary structure, such as a hairpin. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In a hairpin structure the portion of the sequence 5' of the final "N" and upstream of the loop corresponds to the tracr mate sequence, and the portion of the sequence 3' of the loop corresponds to the tracr sequence.

In general, degree of complementarity is with reference to the optimal alignment of the sca sequence and tracr sequence, along the length of the shorter of the two sequences. Optimal alignment may be determined by any suitable alignment algorithm, and may further account for secondary structures, such as self-complementarity within either the sca sequence or tracr sequence. In some embodiments, the degree of complementarity between the tracr sequence and sca sequence along the length of the shorter of the two when optimally aligned is about or more than about 25%, 30%, 40%, 50%, 60%, 70%, 80%, 90%, 95%, 97.5%, 99%, or higher.

In general, the CRISPR-Cas or CRISPR system may be as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, in particular a Cas13 gene in the case of CRISPR-Cas13, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas13, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA or RNA polynucleotides. In some embodiments, a target sequence is located in the nucleus or cytoplasm of a cell, and may include nucleic acids in or from mitochondrial, organelles, vesicles, liposomes or particles present within the cell. In some embodiments, especially for non-nuclear uses, NLSs are not preferred. In some embodiments, a CRISPR system comprises one or more nuclear exports signals (NESs). In some embodiments, a CRISPR system comprises one or more NLSs and one or more NESs. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas to a target genomic locus, are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments of CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In particularly preferred embodiments according to the invention, the guide RNA (capable of guiding Cas to a target locus) may comprise (1) a guide sequence capable of hybridizing to a genomic target locus in the eukaryotic cell; (2) a tracr sequence; and (3) a tracr mate sequence. All (1) to (3) may reside in a single RNA, i.e. an sgRNA (arranged in a 5' to 3' orientation), or the tracr RNA may be a different RNA than the RNA containing the guide and tracr sequence. The tracr hybridizes to the tracr mate sequence and directs the CRISPR/Cas complex to the target sequence. Where the tracr RNA is on a different RNA than the RNA containing the guide and tracr sequence, the length of each RNA may be optimized to be shortened from their respective native lengths, and each may be independently chemically modified to protect from degradation by cellular RNase or otherwise increase stability.

The methods according to the invention as described herein comprehend inducing one or more mutations in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s) or sgRNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 40, 45, 50, 75, 100, 200, 300, 400 or 500 nucleotides at each target sequence of said cell(s) via the guide(s) RNA(s) or sgRNA(s).

For minimization of toxicity and off-target effect, it may be important to control the concentration of Cas mRNA and guide RNA delivered. Optimal concentrations of Cas mRNA and guide RNA can be determined by testing different concentrations in a cellular or non-human eukaryote animal model and using deep sequencing the analyze the extent of modification at potential off-target genomic loci. Alternatively, to minimize the level of toxicity and off-target effect, Cas nickase mRNA (for example *S. pyogenes* Cas9 with the D10A mutation) can be delivered with a pair of guide RNAs targeting a site of interest. Guide sequences and strategies to minimize toxicity and off-target effects can be as in WO 2014/093622 (PCT/US2013/074667); or, via mutation as herein.

Typically, in the context of an endogenous CRISPR system, formation of a CRISPR complex (comprising a guide sequence hybridized to a target sequence and complexed with one or more Cas proteins) results in cleavage of one or both strands in or near (e.g. within 1, 2, 3, 4, 5, 6, 7, 8, 9, 10, 20, 50, or more base pairs from) the target sequence. Without wishing to be bound by theory, the tracr sequence, which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence.

Guide Modifications

In certain embodiments, guides of the invention comprise non-naturally occurring nucleic acids and/or non-naturally occurring nucleotides and/or nucleotide analogs, and/or chemically modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2, Äs and 4, Äs carbons of the ribose ring, peptide nucleic acids (PNA), or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified nucleotides include linkage of chemical moieties at the 2' position, including but not limited to, peptides, nuclear localization sequence (NLS), peptide nucleic acid (PNA), polyethylene glycol (PEG), triethylene glycol, or tetraethyleneglycol (TEG). Further examples of modified bases include, but are not limited to, 2-aminopurine, 5-bromo-uridine, pseudouridine (Œ E®), N1-methylpseudouridine (me1 Œ ®), 5-methoxyuridine (5moU), inosine, 7-methylguanosine. Examples of guide RNA chemical modifications include, without limitation, incorporation of 2'-O-methyl (M), 2'-O-methyl-3'-phosphorothioate (MS), phosphorothioate (PS), S-constrained ethyl(cEt), 2'-O-methyl-3'-thioPACE (MSP), or 2'-O-methyl-3'-phosphonoacetate (MP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9): 985-9, doi: 10.1038/nbt.3290, published online 29 Jun. 2015; Ragdarm et al., 0215, PNAS, E7110-E7111; Allerson et al., J. Med. Chem. 2005, 48:901-904; Bramsen et al., Front. Genet., 2012, 3:154; Deng et al., PNAS, 2015, 112:11870-11875; Sharma et al., MedChemComm., 2014, 5:1454-1471; Hendel et al., Nat. Biotechnol. (2015) 33(9): 985-989; Li et al., Nature Biomedical Engineering, 2017, 1, 0066 DOI: 10.1038/s41551-017-0066; Ryan et al., Nucleic Acids Res. (2018) 46(2): 792-803). In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233: 74-83). In certain embodiments, a guide comprises ribonucleotides in a region that binds to a target DNA and one or more deoxyribonucletides and/or nucleotide analogs in a region that binds to Cas9, Cpf1, C2c1, or Cas13. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), 2'-O-methyl-3'-thioPACE (MSP), or 2'-O-methyl-3'-phosphonoacetate (MP). Such modification can enhance genome editing efficiency (see Hendel et al., Nat. Biotechnol. (2015) 33(9): 985-989; Ryan et al., Nucleic Acids Res. (2018) 46(2): 792-803). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), Rhodamine, peptides, nuclear localization sequence (NLS), peptide nucleic acid (PNA), polyethylene glycol (PEG), triethylene glycol, or tetraethyleneglycol (TEG). In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6: e25312, DOI: 10.7554). In some embodiments, 3 nucleotides at each of the 3' and 5' ends are chemically modified. In a specific embodiment, the modifications comprise 2'-O-methyl or phosphorothioate analogs. In a specific embodiment, 12 nucleotides in the tetraloop and 16 nucleotides in the stem-loop region are replaced with 2'-O-methyl analogs. Such chemical modifications improve in vivo editing and stability (see Finn et al., Cell Reports (2018), 22:2227-2235). In some embodiments, more than 60 or 70 nucleotides of the guide are chemically modified. In some embodiments, this modification comprises replacement of nucleotides with 2'-O-methyl or 2'-fluoro nucleotide analogs or phosphorothioate (PS) modification of phosphodiester bonds. In some embodiments, the chemical modification comprises 2'-O-methyl or 2'-fluoro modification of guide nucleotides extending outside of the nuclease protein when the CRISPR complex is formed or PS modification of 20 to 30 or more nucleotides of the 3'-terminus of the guide. In a particular embodiment, the chemical modification further comprises 2'-O-methyl analogs at the 5' end of the guide or 2'-fluoro analogs in the seed and tail regions. Such chemical modifications improve stability to nuclease degradation and maintain or enhance genome-editing activity or efficiency, but modification of all nucleotides may abolish the function of the guide (see Yin et al., Nat. Biotech. (2018), 35(12): 1179-1187). Such chemical modifications may be guided by knowledge of the structure of the CRISPR complex, including knowledge of the limited number of nuclease and RNA 2'-OH interactions (see Yin et al., Nat. Biotech. (2018), 35(12): 1179-1187). In some embodiments, one or more guide RNA nucleotides may be replaced with DNA nucleotides. In some embodiments, up to 2, 4, 6, 8, 10, or 12 RNA nucleotides of the 5'-end tail/seed guide region are replaced with DNA nucleotides. In certain embodiments, the majority of guide RNA nucleotides at the 3' end are replaced with DNA nucleotides. In particular embodiments, 16 guide RNA nucleotides at the 3' end are replaced with DNA nucleotides. In particular embodiments, 8 guide RNA nucleotides of the 5'-end tail/seed region and 16 RNA nucleotides at the 3' end are replaced with DNA nucleotides. In particular embodiments, guide RNA nucleotides that extend outside of the nuclease protein when the CRISPR complex is formed are replaced with DNA nucleotides. Such replacement of multiple RNA nucleotides with DNA nucleotides leads to decreased off-target activity but similar on-target activity compared to an unmodified guide; however, replacement of all RNA nucleotides at the 3' end may abolish the function of the guide (see Yin et al., Nat. Chem. Biol. (2018) 14, 311-316). Such modifications may be guided by knowledge of the structure of the CRISPR complex, including knowledge of the limited number of nuclease and RNA 2'-OH interactions (see Yin et al., Nat. Chem. Biol. (2018) 14, 311-316).

In one aspect of the invention, the guide comprises a modified crRNA for Cpf1, having a 5'-handle and a guide segment further comprising a seed region and a 3'-terminus. In some embodiments, the modified guide can be used with a Cpf1 of any one of *Acidaminococcus* sp. BV3L6 Cpf1 (AsCpf1); *Francisella tularensis* subsp. *Novicida* U112 Cpf1 (FnCpf1); *L. bacterium* MC2017 Cpf1 (Lb3Cpf1); *Butyrivibrio proteoclasticus* Cpf1 (BpCpf1); *Parcubacteria bacterium* GWC2011_GWC2_44_17 Cpf1 (PbCpf1); *Peregrinibacteria bacterium* GW2011 GWA_33_10 Cpf1 (PeCpf1); *Leptospira inadai* Cpf1 (LiCpf1); *Smithella* sp. SC_K08D17 Cpf1 (SsCpf1); *L. bacterium* MA2020 Cpf1 (Lb2Cpf1); *Porphyromonas crevioricanis* Cpf1 (PcCpf1); *Porphyromonas macacae* Cpf1 (PmCpf1); *Candidatus Methanoplasma termitum* Cpf1 (CMtCpf1); *Eubacterium eligens* Cpf1 (EeCpf1); *Moraxella bovoculi* 237 Cpf1 (MbCpf1); *Prevotella disiens* Cpf1 (PdCpf1); or *L. bacterium* ND2006 Cpf1 (LbCpf1).

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromouridine, pseudouridine (Œ®), N1-methylpseudouridine (me1Œ®), 5-methoxyuridine (5moU), inosine, 7-methylguanosine, 2'-O-methyl-3'-phosphorothioate (MS), S-constrained ethyl(cEt), phosphorothioate (PS), 2'-O-methyl-3'-thioPACE (MSP), or 2'-O-methyl-3'-phosphonoacetate (MP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In some embodiments, all nucleotides are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., Nature Biomedical Engineering, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs. In some embodiments, 3 nucleotides at each of the 3' and 5' ends are chemically modified. In a specific embodiment, the modifications comprise 2'-O-methyl or phosphorothioate analogs. In a specific embodiment, 12 nucleotides in the tetraloop and 16 nucleotides in the stem-loop region are replaced with 2'-O-methyl analogs. Such chemical modifications improve in vivo editing and stability (see Finn et al., Cell Reports (2018), 22:2227-2235).

In some embodiments, the loop of the 5'-handle of the guide is modified. In some embodiments, the loop of the 5'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU. In some embodiments, the guide molecule forms a stemloop with a separate non-covalently linked sequence, which can be DNA or RNA.

Synthetically Linked Guide

In one aspect, the guide comprises a tracr sequence and a tracr mate sequence that are chemically linked or conjugated via a non-phosphodiester bond. In one aspect, the guide comprises a tracr sequence and a tracr mate sequence that are chemically linked or conjugated via a non-nucleotide loop. In some embodiments, the tracr and tracr mate sequences are joined via a non-phosphodiester covalent linker. Examples of the covalent linker include but are not limited to a chemical moiety selected from the group consisting of carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, the tracr and tracr mate sequences are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, the tracr or tracr mate sequences can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sufonyl, ally, propargyl, diene, alkyne, and azide. Once the tracr and the tracr mate sequences are functionalized, a covalent chemical bond or linkage can be formed between the two oligonucleotides. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, the tracr and tracr mate sequences can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317:3-18) or 2'-thionocarbamate (2'-TC) chemistry (Dellinger et al., J. Am. Chem. Soc. (2011) 133:11540-11546; Hendel et al., Nat. Biotechnol. (2015) 33:985-989).

In some embodiments, the tracr and tracr mate sequences can be covalently linked using various bioconjugation reactions, loops, bridges, and non-nucleotide links via modifications of sugar, internucleotide phosphodiester bonds, purine and pyrimidine residues. Sletten et al., Angew. Chem. Int. Ed. (2009) 48:6974-6998; Manoharan, M. Curr. Opin. Chem. Biol. (2004) 8:570-9; Behlke et al., Oligonucleotides (2008) 18:305-19; Watts, et al., Drug. Discov. Today (2008) 13:842-55; Shukla, et al., ChemMedChem (2010) 5:328-49.

In some embodiments, the tracr and tracr mate sequences can be covalently linked using click chemistry. In some embodiments, the tracr and tracr mate sequences can be covalently linked using a triazole linker. In some embodiments, the tracr and tracr mate sequences can be covalently linked using Huisgen 1,3-dipolar cycloaddition reaction involving an alkyne and azide to yield a highly stable triazole linker (He et al., ChemBioChem (2015) 17:1809-1812; WO 2016/186745). In some embodiments, the tracr and tracr mate sequences are covalently linked by ligating a 5'-hexyne tracrRNA and a 3'-azide crRNA. In some embodiments, either or both of the 5'-hexyne tracrRNA and a 3'-azide crRNA can be protected with 2'-acetoxyethl orthoester (2'-ACE) group, which can be subsequently removed using Dharmacon protocol (Scaringe et al., J. Am. Chem. Soc. (1998) 120:11820-11821; Scaringe, Methods Enzymol. (2000) 317:3-18).

In some embodiments, the tracr and tracr mate sequences can be covalently linked via a linker (e.g., a non-nucleotide loop) that comprises a moiety such as spacers, attachments, bioconjugates, chromophores, reporter groups, dye labeled RNAs, and non-naturally occurring nucleotide analogues. More specifically, suitable spacers for purposes of this invention include, but are not limited to, polyethers (e.g., polyethylene glycols, polyalcohols, polypropylene glycol or mixtures of efhylene and propylene glycols), polyamines group (e.g., spennine, spermidine and polymeric derivatives thereof), polyesters (e.g., poly(ethyl acrylate)), polyphosphodiesters, alkylenes, and combinations thereof. Suitable attachments include any moiety that can be added to the linker to add additional properties to the linker, such as but not limited to, fluorescent labels. Suitable bioconjugates include, but are not limited to, peptides, glycosides, lipids, cholesterol, phospholipids, diacyl glycerols and dialkyl glycerols, fatty acids, hydrocarbons, enzyme substrates, steroids, biotin, digoxigenin, carbohydrates, polysaccharides. Suitable chromophores, reporter groups, and dye-labeled RNAs include, but are not limited to, fluorescent dyes such as fluorescein and rhodamine, chemiluminescent, electrochemiluminescent, and bioluminescent marker compounds. The design of example linkers conjugating two RNA components are also described in WO 2004/015075.

The linker (e.g., a non-nucleotide loop) can be of any length. In some embodiments, the linker has a length equivalent to about 0-16 nucleotides. In some embodiments, the linker has a length equivalent to about 0-8 nucleotides. In some embodiments, the linker has a length equivalent to about 0-4 nucleotides. In some embodiments, the linker has a length equivalent to about 2 nucleotides. Example linker design is also described in WO2011/008730.

A typical Type II Cas sgRNA comprises (in 5' to 3' direction): a guide sequence, a poly U tract, a first complimentary stretch (the "repeat"), a loop (tetraloop), a second complimentary stretch (the "anti-repeat" being complimentary to the repeat), a stem, and further stem loops and stems and a poly A (often poly U in RNA) tail (terminator). In preferred embodiments, certain aspects of guide architecture are retained, certain aspect of guide architecture cam be modified, for example by addition, subtraction, or substitution of features, whereas certain other aspects of guide architecture are maintained. Preferred locations for engineered sgRNA modifications, including but not limited to insertions, deletions, and substitutions include guide termini and regions of the sgRNA that are exposed when complexed with CRISPR protein and/or target, for example the tetraloop and/or loop2.

In certain embodiments, guides of the invention comprise specific binding sites (e.g. aptamers) for adapter proteins, which may comprise one or more functional domains (e.g. via fusion protein). When such a guide forms a CRISPR complex (i.e. CRISPR enzyme binding to guide and target) the adapter proteins bind and, the functional domain associated with the adapter protein is positioned in a spatial orientation which is advantageous for the attributed function to be effective. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target and a nuclease (e.g. Fok1) will be advantageously positioned to cleave or partially cleave the target.

The skilled person will understand that modifications to the guide which allow for binding of the adapter+functional domain but not proper positioning of the adapter+functional domain (e.g. due to steric hindrance within the three dimensional structure of the CRISPR complex) are modifications which are not intended. The one or more modified guide may be modified at the tetra loop, the stem loop 1, stem loop 2, or stem loop 3, as described herein, preferably at either the tetra loop or stem loop 2, and most preferably at both the tetra loop and stem loop 2.

The repeat: anti-repeat duplex will be apparent from the secondary structure of the sgRNA. It may be typically a first complimentary stretch after (in 5' to 3' direction) the poly U tract and before the tetraloop; and a second complimentary stretch after (in 5' to 3' direction) the tetraloop and before the poly A tract. The first complimentary stretch (the "repeat") is complimentary to the second complimentary stretch (the "anti-repeat"). As such, they Watson-Crick base pair to form a duplex of dsRNA when folded back on one another. As such, the anti-repeat sequence is the complimentary sequence of the repeat and in terms to A-U or C-G base pairing, but also in terms of the fact that the anti-repeat is in the reverse orientation due to the tetraloop.

In an embodiment of the invention, modification of guide architecture comprises replacing bases in stemloop 2. For example, in some embodiments, "actt" ("acuu" in RNA) and "aagt" ("aagu" in RNA) bases in stemloop2 are replaced with "cgcc" and "gcgg". In some embodiments, "actt" and "aagt" bases in stemloop2 are replaced with complimentary GC-rich regions of 4 nucleotides. In some embodiments, the complimentary GC-rich regions of 4 nucleotides are "cgcc" and "gcgg" (both in 5' to 3' direction). In some embodiments, the complimentary GC-rich regions of 4 nucleotides are "gcgg" and "cgcc" (both in 5' to 3' direction). Other combination of C and G in the complimentary GC-rich regions of 4 nucleotides will be apparent including CCCC and GGGG.

In one aspect, the stemloop 2, e.g., "ACTTgttAAGT" (SEQ ID NO: 313) can be replaced by any "XXXXgtttYYYY", e.g., where XXXX and YYYY represent any complementary sets of nucleotides that together will base pair to each other to create a stem.

In one aspect, the stem comprises at least about 4 bp comprising complementary X and Y sequences, although stems of more, e.g., 5, 6, 7, 8, 9, 10, 11 or 12 or fewer, e.g., 3, 2, base pairs are also contemplated. Thus, for example X2-12 and Y2-12 (wherein X and Y represent any complementary set of nucleotides) may be contemplated. In one aspect, the stem made of the X and Y nucleotides, together with the "gttt," will form a complete hairpin in the overall secondary structure; and, this may be advantageous and the amount of base pairs can be any amount that forms a complete hairpin. In one aspect, any complementary X: Y basepairing sequence (e.g., as to length) is tolerated, so long as the secondary structure of the entire sgRNA is preserved. In one aspect, the stem can be a form of X: Y basepairing that does not disrupt the secondary structure of the whole sgRNA in that it has a DR: tracr duplex, and 3 stemloops. In one aspect, the "gttt" tetraloop that connects ACTT and AAGT (or any alternative stem made of X: Y basepairs) can be any sequence of the same length (e.g., 4 basepair) or longer that does not interrupt the overall secondary structure of the sgRNA. In one aspect, the stemloop can be something that further lengthens stemloop2, e.g. can be MS2 aptamer. In one aspect, the stemloop3 "GGCACCGagtCGGTGC" (SEQ ID NO: 314) can likewise take on a "XXXXXXXagtYYYYYYY" form, e.g., wherein X7 and Y7 represent any complementary sets of nucleotides that together will base pair to each other to create a stem. In one aspect, the stem comprises about 7 bp comprising complementary X and Y sequences, although stems of more or fewer basepairs are also contemplated. In one aspect, the stem made of the X and Y nucleotides, together with the "agt", will form a complete hairpin in the overall secondary structure. In one aspect, any complementary X: Y basepairing sequence is tolerated, so long as the secondary structure of the entire sgRNA is preserved. In one aspect, the stem can be a form of X: Y basepairing that doesn't disrupt the secondary structure of the whole sgRNA in that it has a DR: tracr duplex, and 3 stemloops. In one aspect, the "agt" sequence of the stemloop 3 can be extended or be replaced by an aptamer, e.g., a MS2 aptamer or sequence that otherwise generally preserves the architecture of stemloop3. In one aspect for alternative Stemloops 2 and/or 3, each X and Y pair can refer to any basepair. In one aspect, non-Watson Crick basepairing is contemplated, where such pairing otherwise generally preserves the architecture of the stemloop at that position.

In one aspect, the DR:tracrRNA duplex can be replaced with the form: gYYYYag (N) NNNNxxxxNNNN (AAN) uuRRRRu (using standard IUPAC nomenclature for nucleotides), wherein (N) and (AAN) represent part of the bulge in the duplex, and "xxxx" represents a linker sequence. NNNN on the direct repeat can be anything so long as it basepairs with the corresponding NNNN portion of the tracrRNA. In one aspect, the DR:tracrRNA duplex can be connected by a linker of any length (xxxx . . . ), any base composition, as long as it doesn't alter the overall structure.

In one aspect, the sgRNA structural requirement is to have a duplex and 3 stemloops. In most aspects, the actual sequence requirement for many of the particular base requirements are lax, in that the architecture of the DR:tracrRNA duplex should be preserved, but the sequence that creates the architecture, i.e., the stems, loops, bulges, etc., may be alterred.

Aptamers

One guide with a first aptamer/RNA-binding protein pair can be linked or fused to an activator, whilst a second guide with a second aptamer/RNA-binding protein pair can be linked or fused to a repressor. The guides are for different targets (loci), so this allows one gene to be activated and one repressed. For example, the following schematic shows such an approach:

Guide 1—MS2 aptamer—MS2 RNA-binding protein—VP64 activator; and

Guide 2—PP7 aptamer—PP7 RNA-binding protein—SID4× repressor.

The present invention also relates to orthogonal PP7/MS2 gene targeting. In this example, sgRNA targeting different loci are modified with distinct RNA loops in order to recruit MS2-VP64 or PP7-SID4X, which activate and repress their target loci, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-VP64 activators, while another sgRNA targeting locus B can be modified with PP7 loops, recruiting PP7-SID4X repressor domains. In the same cell, dCas13 can thus mediate orthogonal, locus-specific modifications. This principle can be extended to incorporate other orthogonal RNA-binding proteins such as Q-beta.

An alternative option for orthogonal repression includes incorporating non-coding RNA loops with transactive repressive function into the guide (either at similar positions to the MS2/PP7 loops integrated into the guide or at the 3' terminus of the guide). For instance, guides were designed with non-coding (but known to be repressive) RNA loops (e.g. using the Alu repressor (in RNA) that interferes with RNA polymerase II in mammalian cells). The Alu RNA sequence was located: in place of the MS2 RNA sequences as used herein (e.g. at tetraloop and/or stem loop 2); and/or at 3' terminus of the guide. This gives possible combinations of MS2, PP7 or Alu at the tetraloop and/or stemloop 2 positions, as well as, optionally, addition of Alu at the 3' end of the guide (with or without a linker).

The use of two different aptamers (distinct RNA) allows an activator-adaptor protein fusion and a repressor-adaptor protein fusion to be used, with different guides, to activate expression of one gene, whilst repressing another. They, along with their different guides can be administered together, or substantially together, in a multiplexed approach. A large number of such modified guides can be used all at the same time, for example 10 or 20 or 30 and so forth, whilst only one (or at least a minimal number) of Cas13s to be delivered, as a comparatively small number of Cas13s can be used with a large number of modified guides. The adaptor protein may be associated (preferably linked or fused to) one or more activators or one or more repressors. For example, the adaptor protein may be associated with a first activator and a second activator. The first and second activators may be the same, but they are preferably different activators. For example, one might be VP64, whilst the other might be p65, although these are just examples and other transcriptional activators are envisaged. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the enzyme-guide complex as a whole may be associated with two or more functional domains. For example, there may be two or more functional domains associated with the enzyme, or there may be two or more functional domains associated with the guide (via one or more adaptor proteins), or there may be one or more functional domains associated with the enzyme and one or more functional domains associated with the guide (via one or more adaptor proteins).

The fusion between the adaptor protein and the activator or repressor may include a linker. For example, GlySer linkers GGGS can be used. They can be used in repeats of 3 ($(GGGGS)_3$) (SEQ ID NO: 1) or 6, 9 or even 12 or more, to provide suitable lengths, as required. Linkers can be used between the RNA-binding protein and the functional domain (activator or repressor), or between the CRISPR Enzyme (Cas13) and the functional domain (activator or repressor). The linkers the user to engineer appropriate amounts of "mechanical flexibility".

Dead Guides: Guide RNAs Comprising a Dead Guide Sequence May be Used in the Present Invention In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Nuclease activity may be measured using surveyor analysis or deep sequencing as commonly used in the art, preferably surveyor analysis. Similarly, dead guide sequences may not sufficiently engage in productive base pairing with respect to the ability to promote catalytic activity or to distinguish on-target and off-target binding activity. Briefly, the surveyor assay involves purifying and amplifying a CRISPR target site for a gene and forming heteroduplexes with primers amplifying the CRISPR target site. After re-anneal, the products are treated with SURVEYOR nuclease and SURVEYOR enhancer S (Transgenomics) following the manufacturer's recommended protocols, analyzed on gels, and quantified based upon relative band intensities.

Hence, in a related aspect, the invention provides a non-naturally occurring or engineered composition Cas13 CRISPR-Cas system comprising a functional Cas13 as described herein, and guide RNA (gRNA) wherein the gRNA comprises a dead guide sequence whereby the gRNA is capable of hybridizing to a target sequence such that the Cas13 CRISPR-Cas system is directed to a genomic locus of interest in a cell without detectable indel activity resultant from nuclease activity of a non-mutant Cas13 enzyme of the system as detected by a SURVEYOR assay. For shorthand purposes, a gRNA comprising a dead guide sequence whereby the gRNA is capable of hybridizing to a target sequence such that the Cas13 CRISPR-Cas system is directed to a genomic locus of interest in a cell without detectable indel activity resultant from nuclease activity of a non-mutant Cas13 enzyme of the system as detected by a SURVEYOR assay is herein termed a "dead gRNA". It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to a target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are shorter than respective guide sequences which result in active Cas13-specific indel formation. Dead guides are 5%, 10%, 20%, 30%, 40%, 50%, shorter than respective guides directed to the same Cas13 leading to active Cas13-specific indel formation.

As explained below and known in the art, one aspect of gRNA-Cas specificity is the direct repeat sequence, which is to be appropriately linked to such guides. In particular, this implies that the direct repeat sequences are designed dependent on the origin of the Cas. Thus, structural data available for validated dead guide sequences may be used for designing Cas specific equivalents. Structural similarity between, e.g., the orthologous nuclease domains RuvC of two or more Cas effector proteins may be used to transfer design equivalent dead guides. Thus, the dead guide herein may be appropriately modified in length and sequence to reflect such Cas specific equivalents, allowing for formation of the CRISPR complex and successful binding to the target, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets, for example for activation, repression and/or silencing of gene activity, has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides now allow for the first time to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi: 10.1038/nature14136, incorporated herein by reference), one may assemble a synthetic transcription activation complex consisting of multiple distinct effector domains. Such may be modeled after natural transcription activation processes. For example, an aptamer, which selectively binds an effector (e.g. an activator or repressor; dimerized MS2 bacteriophage coat proteins as fusion proteins with an activator or repressor), or a protein which itself binds an effector (e.g. activator or repressor) may be appended to a dead gRNA tetraloop and/or a stem-loop 2. In the case of MS2, the fusion protein MS2-VP64 binds to the tetraloop and/or stem-loop 2 and in turn mediates transcriptional up-regulation, for example for Neurog2. Other transcriptional activators are, for example, VP64. P65, HSF1, and MyoD1. By mere example of this concept, replacement of the MS2 stem-loops with PP7-interacting stem-loops may be used to recruit repressive elements.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The gene effectors, gene activators, gene repressors may be present in the form of fusion proteins.

In an embodiment, the dead gRNA as described herein or the Cas13 CRISPR-Cas complex as described herein includes a non-naturally occurring or engineered composition comprising two or more adaptor proteins, wherein each protein is associated with one or more functional domains and wherein the adaptor protein binds to the distinct RNA sequence(s) inserted into the at least one loop of the dead gRNA.

Hence, an aspect provides a non-naturally occurring or engineered composition comprising a guide RNA (gRNA) comprising a dead guide sequence capable of hybridizing to a target sequence in a genomic locus of interest in a cell, wherein the dead guide sequence is as defined herein, a Cas13 comprising at least one or more nuclear localization sequences, wherein the Cas13 optionally comprises at least one mutation wherein at least one loop of the dead gRNA is modified by the insertion of distinct RNA sequence(s) that bind to one or more adaptor proteins, and wherein the adaptor protein is associated with one or more functional domains; or, wherein the dead gRNA is modified to have at least one non-coding functional loop, and wherein the composition comprises two or more adaptor proteins, wherein the each protein is associated with one or more functional domains.

In certain embodiments, the adaptor protein is a fusion protein comprising the functional domain, the fusion protein optionally comprising a linker between the adaptor protein and the functional domain, the linker optionally including a GlySer linker.

In certain embodiments, the at least one loop of the dead gRNA is not modified by the insertion of distinct RNA sequence(s) that bind to the two or more adaptor proteins.

In certain embodiments, the one or more functional domains associated with the adaptor protein is a transcriptional activation domain.

In certain embodiments, the one or more functional domains associated with the adaptor protein is a transcriptional activation domain comprising VP64, p65, MyoD1, HSF1, RTA or SET7/9.

In certain embodiments, the one or more functional domains associated with the adaptor protein is a transcriptional repressor domain.

In certain embodiments, the transcriptional repressor domain is a KRAB domain.

In certain embodiments, the transcriptional repressor domain is a NuE domain, NcoR domain, SID domain or a SID4X domain.

In certain embodiments, at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity.

In certain embodiments, the DNA cleavage activity is due to a Fok1 nuclease.

In certain embodiments, the dead gRNA is modified so that, after dead gRNA binds the adaptor protein and further binds to the Cas13 and target, the functional domain is in a spatial orientation allowing for the functional domain to function in its attributed function.

In certain embodiments, the at least one loop of the dead gRNA is tetra loop and/or loop2. In certain embodiments, the tetra loop and loop 2 of the dead gRNA are modified by the insertion of the distinct RNA sequence(s).

In certain embodiments, the insertion of distinct RNA sequence(s) that bind to one or more adaptor proteins is an aptamer sequence. In certain embodiments, the aptamer sequence is two or more aptamer sequences specific to the same adaptor protein. In certain embodiments, the aptamer sequence is two or more aptamer sequences specific to different adaptor protein.

In certain embodiments, the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s, PRR1.

In certain embodiments, the cell is a eukaryotic cell. In certain embodiments, the eukaryotic cell is a mammalian cell, optionally a mouse cell. In certain embodiments, the mammalian cell is a human cell.

In certain embodiments, a first adaptor protein is associated with a p65 domain and a second adaptor protein is associated with a HSF1 domain.

In certain embodiments, the composition comprises a Cas13 CRISPR-Cas complex having at least three functional domains, at least one of which is associated with the Cas13 and at least two of which are associated with dead gRNA.

In certain embodiments, the composition further comprises a second gRNA, wherein the second gRNA is a live gRNA capable of hybridizing to a second target sequence such that a second Cas13 CRISPR-Cas system is directed to a second genomic locus of interest in a cell with detectable indel activity at the second genomic locus resultant from nuclease activity of the Cas13 enzyme of the system.

In certain embodiments, the composition further comprises a plurality of dead gRNAs and/or a plurality of live gRNAs.

One aspect of the invention is to take advantage of the modularity and customizability of the gRNA scaffold to establish a series of gRNA scaffolds with different binding sites (in particular aptamers) for recruiting distinct types of effectors in an orthogonal manner. Again, for matters of example and illustration of the broader concept, replacement of the MS2 stem-loops with PP7-interacting stem-loops may be used to bind/recruit repressive elements, enabling multiplexed bidirectional transcriptional control. Thus, in general, gRNA comprising a dead guide may be employed to provide for multiplex transcriptional control and preferred bidirectional transcriptional control. This transcriptional control is most preferred of genes. For example, one or more gRNA comprising dead guide(s) may be employed in targeting the activation of one or more target genes. At the same time, one or more gRNA comprising dead guide(s) may be employed in targeting the repression of one or more target genes. Such a sequence may be applied in a variety of different combinations, for example the target genes are first repressed and then at an appropriate period other targets are activated, or select genes are repressed at the same time as select genes are activated, followed by further activation and/or repression. As a result, multiple components of one or more biological systems may advantageously be addressed together.

In an aspect, the invention provides nucleic acid molecule(s) encoding dead gRNA or the Cas13 CRISPR-Cas complex or the composition as described herein.

In an aspect, the invention provides a vector system comprising: a nucleic acid molecule encoding dead guide RNA as defined herein. In certain embodiments, the vector system further comprises a nucleic acid molecule(s) encoding Cas13. In certain embodiments, the vector system further comprises a nucleic acid molecule(s) encoding (live) gRNA. In certain embodiments, the nucleic acid molecule or the vector further comprises regulatory element(s) operable in a eukaryotic cell operably linked to the nucleic acid molecule encoding the guide sequence (gRNA) and/or the nucleic acid molecule encoding Cas13 and/or the optional nuclear localization sequence(s).

In another aspect, structural analysis may also be used to study interactions between the dead guide and the active Cas nuclease that enable DNA binding, but no DNA cutting. In this way amino acids important for nuclease activity of Cas are determined. Modification of such amino acids allows for improved Cas enzymes used for gene editing.

A further aspect is combining the use of dead guides as explained herein with other applications of CRISPR, as explained herein as well as known in the art. For example, gRNA comprising dead guide(s) for targeted multiplex gene activation or repression or targeted multiplex bidirectional gene activation/repression may be combined with gRNA comprising guides which maintain nuclease activity, as explained herein. Such gRNA comprising guides which maintain nuclease activity may or may not further include modifications which allow for repression of gene activity (e.g. aptamers). Such gRNA comprising guides which maintain nuclease activity may or may not further include modifications which allow for activation of gene activity (e.g. aptamers). In such a manner, a further means for multiplex gene control is introduced (e.g. multiplex gene targeted activation without nuclease activity/without indel activity may be provided at the same time or in combination with gene targeted repression with nuclease activity).

For example, 1) using one or more gRNA (e.g. 1-50, 1-40, 1-30, 1-20, preferably 1-10, more preferably 1-5) comprising dead guide(s) targeted to one or more genes and further modified with appropriate aptamers for the recruitment of gene activators; 2) may be combined with one or more gRNA (e.g. 1-50, 1-40, 1-30, 1-20, preferably 1-10, more preferably 1-5) comprising dead guide(s) targeted to one or more genes and further modified with appropriate aptamers for the recruitment of gene repressors. 1) and/or 2) may then be combined with 3) one or more gRNA (e.g. 1-50, 1-40, 1-30, 1-20, preferably 1-10, more preferably 1-5) targeted to one or more genes. This combination can then be carried out in turn with 1)+2)+3) with 4) one or more gRNA (e.g. 1-50, 1-40, 1-30, 1-20, preferably 1-10, more preferably 1-5) targeted to one or more genes and further modified with appropriate aptamers for the recruitment of gene activators. This combination can then be carried in turn with 1)+2)+3)+4) with 5) one or more gRNA (e.g. 1-50, 1-40, 1-30, 1-20, preferably 1-10, more preferably 1-5) targeted to one or more genes and further modified with appropriate aptamers for the recruitment of gene repressors. As a result various uses and combinations are included in the invention. For example, combination 1)+2); combination 1)+3); combination 2)+3); combination 1)+2)+3); combination 1)+2)+3)+4); combination 1)+3)+4); combination 2)+3)+4); combination 1)+2)+4); combination 1)+2)+3)+4)+5); combination 1)+3)+4)+5); combination 2)+3)+4)+5); combination 1)+2)+4)+5); combination 1)+2)+3)+5); combination 1)+3)+5); combination 2)+3)+5); combination 1)+2)+5).

In an aspect, the invention provides an algorithm for designing, evaluating, or selecting a dead guide RNA targeting sequence (dead guide sequence) for guiding a Cas13 CRISPR-Cas system to a target gene locus. In particular, it has been determined that dead guide RNA specificity relates to and can be optimized by varying i) GC content and ii) targeting sequence length. In an aspect, the invention provides an algorithm for designing or evaluating a dead guide RNA targeting sequence that minimizes off-target binding or interaction of the dead guide RNA. In an embodiment of the invention, the algorithm for selecting a dead guide RNA targeting sequence for directing a CRISPR system to a gene locus in an organism comprises a) locating one or more CRISPR motifs in the gene locus, analyzing the 20 nt sequence downstream of each CRISPR motif by i) determining the GC content of the sequence; and ii) determining whether there are off-target matches of the 15 downstream nucleotides nearest to the CRISPR motif in the genome of the organism, and c) selecting the 15 nucleotide sequence for use in a dead guide RNA if the GC content of the sequence is 70% or less and no off-target matches are identified. In an embodiment, the sequence is selected for a targeting sequence if the GC content is 60% or less. In certain embodiments, the sequence is selected for a targeting sequence if the GC content is 55% or less, 50% or less, 45% or less, 40% or less, 35% or less or 30% or less. In an embodiment, two or more sequences of the gene locus are analyzed and the sequence having the lowest GC content, or the next lowest GC content, or the next lowest GC content is selected. In an embodiment, the sequence is selected for a targeting sequence if no off-target matches are identified in the genome of the organism. In an embodiment, the targeting sequence is selected if no off-target matches are identified in regulatory sequences of the genome.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 15 nt, or 14 nt, or 13 nt, or 12 nt, or 11 nt downstream of a CRISPR motif can be extended in length at the 3' end to 12 nt, 13 nt, 14 nt, 15 nt, 16 nt, 17 nt, 18 nt, 19 nt, 20 nt, or longer.

The invention provides a method for directing a Cas13 CRISPR-Cas system, including but not limited to a dead Cas13 (dCas13) or functionalized Cas13 system (which may comprise a functionalized Cas13 or functionalized guide) to a gene locus. In an aspect, the invention provides a method for selecting a dead guide RNA targeting sequence and directing a functionalized CRISPR system to a gene locus in an organism. In an aspect, the invention provides a method for selecting a dead guide RNA targeting sequence and effecting gene regulation of a target gene locus by a functionalized Cas13 CRISPR-Cas system. In certain embodiments, the method is used to effect target gene regulation while minimizing off-target effects. In an aspect, the invention provides a method for selecting two or more dead guide RNA targeting sequences and effecting gene regulation of two or more target gene loci by a functionalized Cas13 CRISPR-Cas system. In certain embodiments, the method is used to effect regulation of two or more target gene loci while minimizing off-target effects.

In an aspect, the invention provides a method of selecting a dead guide RNA targeting sequence for directing a functionalized Cas13 to a gene locus in an organism, which comprises: a) locating one or more CRISPR motifs in the gene locus; b) analyzing the sequence downstream of each CRISPR motif by: i) selecting 10 to 15 nt adjacent to the CRISPR motif, ii) determining the GC content of the sequence; and c) selecting the 10 to 15 nt sequence as a targeting sequence for use in a guide RNA if the GC content of the sequence is 40% or more. In an embodiment, the sequence is selected if the GC content is 50% or more. In an embodiment, the sequence is selected if the GC content is 60% or more. In an embodiment, the sequence is selected if the GC content is 70% or more. In an embodiment, two or more sequences are analyzed and the sequence having the highest GC content is selected. In an embodiment, the method further comprises adding nucleotides to the 3' end of the selected sequence which do not match the sequence downstream of the CRISPR motif. An aspect provides a dead guide RNA comprising the targeting sequence selected according to the aforementioned methods.

In an aspect, the invention provides a dead guide RNA for directing a functionalized CRISPR system to a gene locus in an organism wherein the targeting sequence of the dead guide RNA consists of 10 to 15 nucleotides adjacent to the CRISPR motif of the gene locus, wherein the CG content of the target sequence is 50% or more. In certain embodiments, the dead guide RNA further comprises nucleotides added to the 3' end of the targeting sequence which do not match the sequence downstream of the CRISPR motif of the gene locus.

In an aspect, the invention provides for a single effector to be directed to one or more, or two or more gene loci. In certain embodiments, the effector is associated with a Cas13, and one or more, or two or more selected dead guide RNAs are used to direct the Cas13-associated effector to one or more, or two or more selected target gene loci. In certain embodiments, the effector is associated with one or more, or two or more selected dead guide RNAs, each selected dead guide RNA, when complexed with a Cas13 enzyme, causing its associated effector to localize to the dead guide RNA target. One non-limiting example of such CRISPR systems modulates activity of one or more, or two or more gene loci subject to regulation by the same transcription factor.

In an aspect, the invention provides for two or more effectors to be directed to one or more gene loci. In certain embodiments, two or more dead guide RNAs are employed, each of the two or more effectors being associated with a selected dead guide RNA, with each of the two or more effectors being localized to the selected target of its dead guide RNA. One non-limiting example of such CRISPR systems modulates activity of one or more, or two or more gene loci subject to regulation by different transcription factors. Thus, in one non-limiting embodiment, two or more transcription factors are localized to different regulatory sequences of a single gene. In another non-limiting embodiment, two or more transcription factors are localized to different regulatory sequences of different genes. In certain embodiments, one transcription factor is an activator. In certain embodiments, one transcription factor is an inhibitor. In certain embodiments, one transcription factor is an activator and another transcription factor is an inhibitor. In certain embodiments, gene loci expressing different components of the same regulatory pathway are regulated. In certain embodiments, gene loci expressing components of different regulatory pathways are regulated.

In an aspect, the invention also provides a method and algorithm for designing and selecting dead guide RNAs that are specific for target DNA cleavage or target binding and gene regulation mediated by an active Cas13 CRISPR-Cas system. In certain embodiments, the Cas13 CRISPR-Cas system provides orthogonal gene control using an active Cas13 which cleaves target DNA at one gene locus while at the same time binds to and promotes regulation of another gene locus.

In an aspect, the invention provides an method of selecting a dead guide RNA targeting sequence for directing a functionalized Cas13 to a gene locus in an organism, without cleavage, which comprises a) locating one or more CRISPR motifs in the gene locus; b) analyzing the sequence downstream of each CRISPR motif by i) selecting 10 to 15 nt adjacent to the CRISPR motif, ii) determining the GC content of the sequence, and c) selecting the 10 to 15 nt sequence as a targeting sequence for use in a dead guide RNA if the GC content of the sequence is 30% more, 40% or more. In certain embodiments, the GC content of the targeting sequence is 35% or more, 40% or more, 45% or more, 50% or more, 55% or more, 60% or more, 65% or more, or 70% or more. In certain embodiments, the GC content of the targeting sequence is from 30% to 40% or from 40% to 50% or from 50% to 60% or from 60% to 70%. In an embodiment of the invention, two or more sequences in a gene locus are analyzed and the sequence having the highest GC content is selected.

In an embodiment of the invention, the portion of the targeting sequence in which GC content is evaluated is 10 to 15 contiguous nucleotides of the 15 target nucleotides nearest to the PAM. In an embodiment of the invention, the portion of the guide in which GC content is considered is the 10 to 11 nucleotides or 11 to 12 nucleotides or 12 to 13 nucleotides or 13, or 14, or 15 contiguous nucleotides of the 15 nucleotides nearest to the PAM.

In an aspect, the invention further provides an algorithm for identifying dead guide RNAs which promote CRISPR system gene locus cleavage while avoiding functional activation or inhibition. It is observed that increased GC content in dead guide RNAs of 16 to 20 nucleotides coincides with increased DNA cleavage and reduced functional activation.

It is also demonstrated herein that efficiency of functionalized Cas13 can be increased by addition of nucleotides to the 3' end of a guide RNA which do not match a target sequence downstream of the CRISPR motif. For example, of dead guide RNA 11 to 15 nt in length, shorter guides may be less likely to promote target cleavage, but are also less efficient at promoting CRISPR system binding and functional control. In certain embodiments, addition of nucleotides that don't match the target sequence to the 3' end of the dead guide RNA increase activation efficiency while not increasing undesired target cleavage. In an aspect, the invention also provides a method and algorithm for identifying improved dead guide RNAs that effectively promote CRISPRP system function in DNA binding and gene regulation while not promoting DNA cleavage. Thus, in certain embodiments, the invention provides a dead guide RNA that includes the first 15 nt, or 14 nt, or 13 nt, or 12 nt, or 11 nt downstream of a CRISPR motif and is extended in length at the 3' end by nucleotides that mismatch the target to 12 nt, 13 nt, 14 nt, 15 nt, 16 nt, 17 nt, 18 nt, 19 nt, 20 nt, or longer.

In an aspect, the invention provides a method for effecting selective orthogonal gene control. As will be appreciated from the disclosure herein, dead guide selection according to the invention, taking into account guide length and GC content, provides effective and selective transcription control by a functional Cas13 CRISPR-Cas system, for example to regulate transcription of a gene locus by activation or inhibition and minimize off-target effects. Accordingly, by providing effective regulation of individual target loci, the invention also provides effective orthogonal regulation of two or more target loci.

In certain embodiments, orthogonal gene control is by activation or inhibition of two or more target loci. In certain embodiments, orthogonal gene control is by activation or inhibition of one or more target locus and cleavage of one or more target locus.

In one aspect, the invention provides a cell comprising a non-naturally occurring Cas13 CRISPR-Cas system comprising one or more dead guide RNAs disclosed or made according to a method or algorithm described herein wherein the expression of one or more gene products has been altered. In an embodiment of the invention, the expression in the cell of two or more gene products has been altered. The invention also provides a cell line from such a cell.

In one aspect, the invention provides a multicellular organism comprising one or more cells comprising a non-naturally occurring Cas13 CRISPR-Cas system comprising one or more dead guide RNAs disclosed or made according to a method or algorithm described herein. In one aspect, the invention provides a product from a cell, cell line, or multicellular organism comprising a non-naturally occurring Cas13 CRISPR-Cas system comprising one or more dead guide RNAs disclosed or made according to a method or algorithm described herein.

A further aspect of this invention is the use of gRNA comprising dead guide(s) as described herein, optionally in combination with gRNA comprising guide(s) as described herein or in the state of the art, in combination with systems e.g. cells, transgenic animals, transgenic mice, inducible transgenic animals, inducible transgenic mice) which are engineered for either overexpression of Cas13 or preferably knock in Cas13. As a result a single system (e.g. transgenic animal, cell) can serve as a basis for multiplex gene modifications in systems/network biology. On account of the dead guides, this is now possible in both in vitro, ex vivo, and in vivo.

For example, once the Cas13 is provided for, one or more dead gRNAs may be provided to direct multiplex gene regulation, and preferably multiplex bidirectional gene regulation. The one or more dead gRNAs may be provided in a spatially and temporally appropriate manner if necessary or desired (for example tissue specific induction of Cas13 expression). On account that the transgenic/inducible Cas13 is provided for (e.g. expressed) in the cell, tissue, animal of interest, both gRNAs comprising dead guides or gRNAs comprising guides are equally effective. In the same manner, a further aspect of this invention is the use of gRNA comprising dead guide(s) as described herein, optionally in combination with gRNA comprising guide(s) as described herein or in the state of the art, in combination with systems (e.g. cells, transgenic animals, transgenic mice, inducible transgenic animals, inducible transgenic mice) which are engineered for knockout Cas13 CRISPR-Cas.

As a result, the combination of dead guides as described herein with CRISPR applications described herein and CRISPR applications known in the art results in a highly efficient and accurate means for multiplex screening of systems (e.g. network biology). Such screening allows, for example, identification of specific combinations of gene activities for identifying genes responsible for diseases (e.g. on/off combinations), in particular gene related diseases. A preferred application of such screening is cancer. In the same manner, screening for treatment for such diseases is included in the invention. Cells or animals may be exposed to aberrant conditions resulting in disease or disease like effects. Candidate compositions may be provided and screened for an effect in the desired multiplex environment. For example a patient's cancer cells may be screened for which gene combinations will cause them to die, and then use this information to establish appropriate therapies.

In one aspect, the invention provides a kit comprising one or more of the components described herein. The kit may include dead guides as described herein with or without guides as described herein.

The structural information provided herein allows for interrogation of dead gRNA interaction with the target DNA and the Cas13 permitting engineering or alteration of dead gRNA structure to optimize functionality of the entire Cas13 CRISPR-Cas system. For example, loops of the dead gRNA may be extended, without colliding with the Cas13 protein by the insertion of adaptor proteins that can bind to RNA. These adaptor proteins can further recruit effector proteins or fusions which comprise one or more functional domains.

In some preferred embodiments, the functional domain is a transcriptional activation domain, preferably VP64. In some embodiments, the functional domain is a transcription repression domain, preferably KRAB. In some embodiments, the transcription repression domain is SID, or concatemers of SID (e.g. SID4X). In some embodiments, the functional domain is an epigenetic modifying domain, such that an epigenetic modifying enzyme is provided. In some embodiments, the functional domain is an activation domain, which may be the P65 activation domain.

An aspect of the invention is that the above elements are comprised in a single composition or comprised in individual compositions. These compositions may advantageously be applied to a host to elicit a functional effect on the genomic level.

In general, the dead gRNA is modified in a manner that provides specific binding sites (e.g. aptamers) for adapter proteins comprising one or more functional domains (e.g. via fusion protein) to bind to. The modified dead gRNA is modified such that once the dead gRNA forms a CRISPR complex (i.e. Cas13 binding to dead gRNA and target) the adapter proteins bind and, the functional domain on the adapter protein is positioned in a spatial orientation which is advantageous for the attributed function to be effective. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target and a nuclease (e.g. Fok1) will be advantageously positioned to cleave or partially cleave the target.

The skilled person will understand that modifications to the dead gRNA which allow for binding of the adapter+ functional domain but not proper positioning of the adapter+ functional domain (e.g. due to steric hindrance within the three dimensional structure of the CRISPR complex) are modifications which are not intended. The one or more modified dead gRNA may be modified at the tetra loop, the stem loop 1, stem loop 2, or stem loop 3, as described herein, preferably at either the tetra loop or stem loop 2, and most preferably at both the tetra loop and stem loop 2.

As explained herein the functional domains may be, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). In some cases it is advantageous that additionally at least one NLS is provided. In some instances, it is advantageous to position the NLS at the N terminus. When more than one functional domain is included, the functional domains may be the same or different.

The dead gRNA may be designed to include multiple binding recognition sites (e.g. aptamers) specific to the same or different adapter protein. The dead gRNA may be designed to bind to the promoter region-1000-+1 nucleic acids upstream of the transcription start site (i.e. TSS), preferably −200 nucleic acids. This positioning improves functional domains which affect gene activation (e.g. transcription activators) or gene inhibition (e.g. transcription repressors). The modified dead gRNA may be one or more modified dead gRNAs targeted to one or more target loci (e.g. at least 1 gRNA, at least 2 gRNA, at least 5 gRNA, at least 10 gRNA, at least 20 gRNA, at least 30 gRNA, at least 50 gRNA) comprised in a composition.

The adaptor protein may be any number of proteins that binds to an aptamer or recognition site introduced into the modified dead gRNA and which allows proper positioning of one or more functional domains, once the dead gRNA has been incorporated into the CRISPR complex, to affect the target with the attributed function. As explained in detail in this application such may be coat proteins, preferably bacteriophage coat proteins. The functional domains associated with such adaptor proteins (e.g. in the form of fusion protein) may include, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that the functional domain is a transcription activator or transcription repressor it is advantageous that additionally at least an NLS is provided and preferably at the N terminus. When more than one functional domain is included, the functional domains may be the same or different. The adaptor protein may utilize known linkers to attach such functional domains.

Thus, the modified dead gRNA, the (inactivated) Cas13 (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA selection) and concentration of gRNA (e.g. dependent on whether multiple gRNAs are used) may be advantageous for eliciting an improved effect.

On the basis of this concept, several variations are appropriate to elicit a genomic locus event, including DNA cleavage, gene activation, or gene deactivation. Using the provided compositions, the person skilled in the art can advantageously and specifically target single or multiple loci with the same or different functional domains to elicit one or more genomic locus events. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR transgenic cell/animals, which are not believed prior to the present invention or application. For example, the target cell comprises Cas13 conditionally or inducibly (e.g. in the form of Cre dependent constructs) and/or the adapter protein conditionally or inducibly and, on expression of a vector introduced into the target cell, the vector expresses that which induces or gives rise to the condition of Cas13 expression and/or adaptor expression in the target cell. By applying the teaching and compositions of the current invention with the known method of creating a CRISPR complex, inducible genomic events affected by functional domains are also an aspect of the current invention. One example of this is the creation of a CRISPR knock-in/conditional transgenic animal (e.g. mouse comprising e.g. a Lox-Stop-polyA-Lox (LSL) cassette) and subsequent delivery of one or more compositions providing one or more modified dead gRNA (e.g. −200 nucleotides to TSS of a target gene of interest for gene activation purposes) as described herein (e.g. modified dead gRNA with one or more aptamers recognized by coat proteins, e.g. MS2), one or more adapter proteins as described herein (MS2 binding protein linked to one or more VP64) and means for inducing the conditional animal (e.g. Cre recombinase for rendering Cas13 expression inducible). Alternatively, the adaptor protein may be provided as a conditional or inducible element with a conditional or inducible Cas13 to provide an effective model for screening purposes, which advantageously only requires minimal design and administration of specific dead gRNAs for a broad number of applications.

In another aspect the dead guides are further modified to improve specificity. Protected dead guides may be synthesized, whereby secondary structure is introduced into the 3' end of the dead guide to improve its specificity. A protected guide RNA (pgRNA) comprises a guide sequence capable of hybridizing to a target sequence in a genomic locus of interest in a cell and a protector strand, wherein the protector strand is optionally complementary to the guide sequence and wherein the guide sequence may in part be hybridizable to the protector strand. The pgRNA optionally includes an extension sequence. The thermodynamics of the pgRNA-target DNA hybridization is determined by the number of bases complementary between the guide RNA and target DNA. By employing 'thermodynamic protection', specificity of dead gRNA can be improved by adding a protector sequence. For example, one method adds a complementary protector strand of varying lengths to the 3' end of the guide sequence within the dead gRNA. As a result, the protector strand is bound to at least a portion of the dead gRNA and provides for a protected gRNA (pgRNA). In turn, the dead gRNA references herein may be easily protected using the described embodiments, resulting in pgRNA. The protector strand can be either a separate RNA transcript or strand or a chimeric version joined to the 3' end of the dead gRNA guide sequence. Tandem guides and uses in a multiplex (tandem) targeting approach The inventors have shown that CRISPR enzymes as defined herein can employ more than one RNA guide without losing activity. This enables the use of the CRISPR enzymes, systems or complexes as defined herein for targeting multiple DNA targets, genes or gene loci, with a single enzyme, system or complex as defined herein. The guide RNAs may be tandemly arranged, optionally separated by a nucleotide sequence such as a direct repeat as defined herein. The position of the different guide RNAs is the tandem does not influence the activity. It is noted that the terms "CRISPR-Cas system", "CRISP-Cas complex" "CRISPR complex" and "CRISPR system" are used interchangeably. Also the terms "CRISPR enzyme", "Cas enzyme", or "CRISPR-Cas enzyme", can be used interchangeably. In preferred embodiments, said CRISPR enzyme, CRISP-Cas enzyme or Cas enzyme is Cas13, or any one of the modified or mutated variants thereof described herein elsewhere.

In one aspect, the invention provides a non-naturally occurring or engineered CRISPR enzyme, preferably a class 2 CRISPR enzyme, preferably a Type V or VI CRISPR enzyme as described herein, such as without limitation Cas13 as described herein elsewhere, used for tandem or multiplex targeting. It is to be understood that any of the CRISPR (or CRISPR-Cas or Cas) enzymes, complexes, or systems according to the invention as described herein elsewhere may be used in such an approach. Any of the methods, products, compositions and uses as described herein elsewhere are equally applicable with the multiplex or tandem targeting approach further detailed below. By means of further guidance, the following particular aspects and embodiments are provided.

In one aspect, the invention provides for the use of a Cas13 enzyme, complex or system as defined herein for targeting multiple gene loci. In one embodiment, this can be established by using multiple (tandem or multiplex) guide RNA (gRNA) sequences.

In one aspect, the invention provides methods for using one or more elements of a Cas13 enzyme, complex or system as defined herein for tandem or multiplex targeting, wherein said CRISP system comprises multiple guide RNA sequences. Preferably, said gRNA sequences are separated by a nucleotide sequence, such as a direct repeat as defined herein elsewhere.

The Cas13 enzyme, system or complex as defined herein provides an effective means for modifying multiple target polynucleotides. The Cas13 enzyme, system or complex as defined herein has a wide variety of utility including modifying (e.g., deleting, inserting, translocating, inactivating, activating) one or more target polynucleotides in a multiplicity of cell types. As such the Cas13 enzyme, system or complex as defined herein of the invention has a broad spectrum of applications in, e.g., gene therapy, drug screening, disease diagnosis, and prognosis, including targeting multiple gene loci within a single CRISPR system.

In one aspect, the invention provides a Cas13 enzyme, system or complex as defined herein, i.e. a Cas13 CRISPR-Cas complex having a Cas13 protein having at least one destabilization domain associated therewith, and multiple guide RNAs that target multiple nucleic acid molecules such as DNA molecules, whereby each of said multiple guide RNAs specifically targets its corresponding nucleic acid molecule, e.g., DNA molecule. Each nucleic acid molecule target, e.g., DNA molecule can encode a gene product or encompass a gene locus. Using multiple guide RNAs hence enables the targeting of multiple gene loci or multiple genes. In some embodiments the Cas13 enzyme may cleave the RNA molecule encoding the gene product. In some embodiments expression of the gene product is altered. The Cas13 protein and the guide RNAs do not naturally occur together. The invention comprehends the guide RNAs comprising tandemly arranged guide sequences. The invention further comprehends coding sequences for the Cas13 protein being codon optimized for expression in a eukaryotic cell. In a preferred embodiment the eukaryotic cell is a mammalian cell, a plant cell or a yeast cell and in a more preferred embodiment the mammalian cell is a human cell. Expression of the gene product may be decreased. The Cas13 enzyme may form part of a CRISPR system or complex, which further comprises tandemly arranged guide RNAs (gRNAs) comprising a series of 2, 3, 4, 5, 6, 7, 8, 9, 10, 15, 25, 25, 30, or more than 30 guide sequences, each capable of specifically hybridizing to a target sequence in a genomic locus of interest in a cell. In some embodiments, the functional Cas13 CRISPR system or complex binds to the multiple target sequences. In some embodiments, the functional CRISPR system or complex may edit the multiple target sequences, e.g., the target sequences may comprise a genomic locus, and in some embodiments there may be an alteration of gene expression. In some embodiments, the functional CRISPR system or complex may comprise further functional domains. In some embodiments, the invention provides a method for altering or modifying expression of multiple gene products. The method may comprise introducing into a cell containing said target nucleic acids, e.g., DNA molecules, or containing and expressing target nucleic acid, e.g., DNA molecules; for instance, the target nucleic acids may encode gene products or provide for expression of gene products (e.g., regulatory sequences).

In preferred embodiments the CRISPR enzyme used for multiplex targeting is Cas13, or the CRISPR system or complex comprises Cas13. In some embodiments, the CRISPR enzyme used for multiplex targeting is AsCas13, or the CRISPR system or complex used for multiplex targeting comprises an AsCas13. In some embodiments, the CRISPR enzyme is an LbCas13, or the CRISPR system or complex comprises LbCas13. In some embodiments, the Cas enzyme used for multiplex targeting cleaves both strands of DNA to produce a double strand break (DSB). In some embodiments, the CRISPR enzyme used for multiplex targeting is a nickase. In some embodiments, the Cas13 enzyme used for multiplex targeting is a dual nickase. In some embodiments, the Cas13 enzyme used for multiplex targeting is a Cas13 enzyme such as a DD Cas13 enzyme as defined herein elsewhere.

In some general embodiments, the Cas13 enzyme used for multiplex targeting is associated with one or more functional domains. In some more specific embodiments, the CRISPR enzyme used for multiplex targeting is a deadCas13 as defined herein elsewhere.

In an aspect, the present invention provides a means for delivering the Cas13 enzyme, system or complex for use in multiple targeting as defined herein or the polynucleotides defined herein. Non-limiting examples of such delivery means are e.g. particle(s) delivering component(s) of the complex, vector(s) comprising the polynucleotide(s) discussed herein (e.g., encoding the CRISPR enzyme, providing the nucleotides encoding the CRISPR complex). In some embodiments, the vector may be a plasmid or a viral vector such as AAV, or lentivirus. Transient transfection with plasmids, e.g., into HEK cells may be advantageous, especially given the size limitations of AAV and that while Cas13 fits into AAV, one may reach an upper limit with additional guide RNAs.

Also provided is a model that constitutively expresses the Cas13 enzyme, complex or system as used herein for use in multiplex targeting. The organism may be transgenic and may have been transfected with the present vectors or may be the offspring of an organism so transfected. In a further aspect, the present invention provides compositions comprising the CRISPR enzyme, system and complex as defined herein or the polynucleotides or vectors described herein. Also provides are Cas13 CRISPR systems or complexes comprising multiple guide RNAs, preferably in a tandemly arranged format. Said different guide RNAs may be separated by nucleotide sequences such as direct repeats.

Also provided is a method of treating a subject, e.g., a subject in need thereof, comprising inducing gene editing by transforming the subject with the polynucleotide encoding the Cas13 CRISPR system or complex or any of polynucleotides or vectors described herein and administering them to the subject. A suitable repair template may also be provided, for example delivered by a vector comprising said repair template. Also provided is a method of treating a subject, e.g., a subject in need thereof, comprising inducing transcriptional activation or repression of multiple target gene loci by transforming the subject with the polynucleotides or vectors described herein, wherein said polynucleotide or vector encodes or comprises the Cas13 enzyme, complex or system comprising multiple guide RNAs, preferably tandemly arranged. Where any treatment is occurring ex vivo, for example in a cell culture, then it will be appreciated that the term 'subject' may be replaced by the phrase "cell or cell culture."

Compositions comprising Cas13 enzyme, complex or system comprising multiple guide RNAs, preferably tandemly arranged, or the polynucleotide or vector encoding or comprising said Cas13 enzyme, complex or system comprising multiple guide RNAs, preferably tandemly arranged, for use in the methods of treatment as defined herein elsewhere are also provided. A kit of parts may be provided including such compositions. Use of said composition in the manufacture of a medicament for such methods of treatment are also provided. Use of a Cas13 CRISPR system in screening is also provided by the present invention, e.g., gain of function screens. Cells which are artificially forced to overexpress a gene are be able to down regulate the gene over time (re-establishing equilibrium) e.g. by negative feedback loops. By the time the screen starts the unregulated gene might be reduced again. Using an inducible Cas13 activator allows one to induce transcription right before the screen and therefore minimizes the chance of false negative hits. Accordingly, by use of the instant invention in screening, e.g., gain of function screens, the chance of false negative results may be minimized.

In one aspect, the invention provides an engineered, non-naturally occurring CRISPR system comprising a Cas13 protein and multiple guide RNAs that each specifically target a DNA molecule encoding a gene product in a cell, whereby the multiple guide RNAs each target their specific DNA molecule encoding the gene product and the Cas13 protein cleaves the target DNA molecule encoding the gene product, whereby expression of the gene product is altered; and, wherein the CRISPR protein and the guide RNAs do not naturally occur together. The invention comprehends the multiple guide RNAs comprising multiple guide sequences, preferably separated by a nucleotide sequence such as a direct repeat and optionally fused to a tracr sequence. In an embodiment of the invention the CRISPR protein is a type V or VI CRISPR-Cas protein and in a more preferred embodiment the CRISPR protein is a Cas13 protein. The invention further comprehends a Cas13 protein being codon optimized for expression in a eukaryotic cell. In a preferred embodiment the eukaryotic cell is a mammalian cell and in a more preferred embodiment the mammalian cell is a human cell. In a further embodiment of the invention, the expression of the gene product is decreased.

In another aspect, the invention provides an engineered, non-naturally occurring vector system comprising one or more vectors comprising a first regulatory element operably linked to the multiple Cas13 CRISPR system guide RNAs that each specifically target a DNA molecule encoding a gene product and a second regulatory element operably linked coding for a CRISPR protein. Both regulatory elements may be located on the same vector or on different vectors of the system. The multiple guide RNAs target the multiple DNA molecules encoding the multiple gene products in a cell and the CRISPR protein may cleave the multiple DNA molecules encoding the gene products (it may cleave one or both strands or have substantially no nuclease activity), whereby expression of the multiple gene products is altered; and, wherein the CRISPR protein and the multiple guide RNAs do not naturally occur together. In a preferred embodiment the CRISPR protein is Cas13 protein, optionally codon optimized for expression in a eukaryotic cell. In a preferred embodiment the eukaryotic cell is a mammalian cell, a plant cell or a yeast cell and in a more preferred embodiment the mammalian cell is a human cell. In a further embodiment of the invention, the expression of each of the multiple gene products is altered, preferably decreased.

In one aspect, the invention provides a vector system comprising one or more vectors. In some embodiments, the system comprises: (a) a first regulatory element operably linked to a direct repeat sequence and one or more insertion sites for inserting one or more guide sequences up- or downstream (whichever applicable) of the direct repeat sequence, wherein when expressed, the one or more guide sequence(s) direct(s) sequence-specific binding of the CRISPR complex to the one or more target sequence(s) in a eukaryotic cell, wherein the CRISPR complex comprises a Cas13 enzyme complexed with the one or more guide sequence(s) that is hybridized to the one or more target sequence(s); and (b) a second regulatory element operably linked to an enzyme-coding sequence encoding said Cas13 enzyme, preferably comprising at least one nuclear localization sequence and/or at least one NES; wherein components (a) and (b) are located on the same or different vectors of the system. Where applicable, a tracr sequence may also be provided. In some embodiments, component (a) further comprises two or more guide sequences operably linked to the first regulatory element, wherein when expressed, each of the two or more guide sequences direct sequence specific binding of a Cas13 CRISPR complex to a different target sequence in a eukaryotic cell. In some embodiments, the CRISPR complex comprises one or more nuclear localization sequences and/or one or more NES of sufficient strength to drive accumulation of said Cas13 CRISPR complex in a detectable amount in or out of the nucleus of a eukaryotic cell. In some embodiments, the first regulatory element is a polymerase III promoter. In some embodiments, the second regulatory element is a polymerase II promoter. In some embodiments, each of the guide sequences is at least 16, 17, 18, 19, 20, 25 nucleotides, or between 16-30, or between 16-25, or between 16-20 nucleotides in length.

Recombinant expression vectors can comprise the polynucleotides encoding the Cas13 enzyme, system or complex for use in multiple targeting as defined herein in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

In some embodiments, a host cell is transiently or non-transiently transfected with one or more vectors comprising the polynucleotides encoding the Cas13 enzyme, system or complex for use in multiple targeting as defined herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art and exemplified herein elsewhere. Cell lines are available from a variety of sources known to those with skill in the art (see, e.g., the American Type Culture Collection (ATCC) (Manassas, Va.)). In some embodiments, a cell transfected with one or more vectors comprising the polynucleotides encoding the Cas13 enzyme, system or complex for use in multiple targeting as defined herein is used to establish a new cell line comprising one or more vector-derived sequences. In some embodiments, a cell transiently transfected with the components of a Cas13 CRISPR system or complex for use in multiple targeting as described herein (such as by transient transfection of one or more vectors, or transfection with RNA), and modified through the activity of a Cas13 CRISPR system or complex, is used to establish a new cell line comprising cells containing the modification but lacking any other exogenous sequence. In some embodiments, cells transiently or non-transiently transfected with one or more vectors comprising the polynucleotides encoding the Cas13 enzyme, system or complex for use in multiple targeting as defined herein, or cell lines derived from such cells are used in assessing one or more test compounds.

The term "regulatory element" is as defined herein elsewhere.

Advantageous vectors include lentiviruses and adeno-associated viruses, and types of such vectors can also be selected for targeting particular types of cells.

In one aspect, the invention provides a eukaryotic host cell comprising (a) a first regulatory element operably linked to a direct repeat sequence and one or more insertion sites for inserting one or more guide RNA sequences up- or downstream (whichever applicable) of the direct repeat sequence, wherein when expressed, the guide sequence(s) direct(s) sequence-specific binding of the Cas13 CRISPR complex to the respective target sequence(s) in a eukaryotic cell, wherein the Cas13 CRISPR complex comprises a Cas13 enzyme complexed with the one or more guide sequence(s) that is hybridized to the respective target sequence(s); and/or (b) a second regulatory element operably linked to an enzyme-coding sequence encoding said Cas13 enzyme comprising preferably at least one nuclear localization sequence and/or NES. In some embodiments, the host cell comprises components (a) and (b). Where applicable, a tracr sequence may also be provided. In some embodiments, component (a), component (b), or components (a) and (b) are stably integrated into a genome of the host eukaryotic cell. In some embodiments, component (a) further comprises two or more guide sequences operably linked to the first regulatory element, and optionally separated by a direct repeat, wherein when expressed, each of the two or more guide sequences direct sequence specific binding of a Cas13 CRISPR complex to a different target sequence in a eukaryotic cell. In some embodiments, the Cas13 enzyme comprises one or more nuclear localization sequences and/or nuclear export sequences or NES of sufficient strength to drive accumulation of said CRISPR enzyme in a detectable amount in and/or out of the nucleus of a eukaryotic cell.

In some embodiments, the Cas13 enzyme is a type V or VI CRISPR system enzyme. In some embodiments, the Cas enzyme is a Cas13 enzyme. In some embodiments, the Cas13 enzyme is derived from *Francisella tularensis* 1, *Francisella tularensis* subsp. *novicida, Prevotella albensis, Lachnospiraceae bacterium* MC2017 1, *Butyrivibrio proteoclasticus, Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens*, or *Porphyromonas macacae* Cas13, and may include further alterations or mutations of the Cas13 as defined herein elsewhere, and can be a chimeric Cas13. In some embodiments, the Cas13 enzyme is codon-optimized for expression in a eukaryotic cell. In some embodiments, the CRISPR enzyme directs cleavage of one or two strands at the location of the target sequence. In some embodiments, the first regulatory element is a polymerase III promoter. In some embodiments, the second regulatory element is a polymerase II promoter. In some embodiments, the one or more guide sequence(s) is (are each) at least 16, 17, 18, 19, 20, 25 nucleotides, or between 16-30, or between 16-25, or between 16-20 nucleotides in length. When multiple guide RNAs are used, they are preferably separated by a direct repeat sequence. In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The organism also may be a plant. Further, the organism may be a fungus.

In one aspect, the invention provides a kit comprising one or more of the components described herein. In some embodiments, the kit comprises a vector system and instructions for using the kit. In some embodiments, the vector system comprises (a) a first regulatory element operably linked to a direct repeat sequence and one or more insertion sites for inserting one or more guide sequences up- or downstream (whichever applicable) of the direct repeat sequence, wherein when expressed, the guide sequence directs sequence-specific binding of a Cas13 CRISPR complex to a target sequence in a eukaryotic cell, wherein the Cas13 CRISPR complex comprises a Cas13 enzyme complexed with the guide sequence that is hybridized to the target sequence; and/or (b) a second regulatory element operably linked to an enzyme-coding sequence encoding said Cas13 enzyme comprising a nuclear localization sequence. Where applicable, a tracr sequence may also be provided. In some embodiments, the kit comprises components (a) and (b) located on the same or different vectors of the system. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the Cas13 enzyme comprises one or more nuclear localization sequences of sufficient strength to drive accumulation of said CRISPR enzyme in a detectable amount in the nucleus of a eukaryotic cell. In some embodiments, the CRISPR enzyme is a type V or VI CRISPR system enzyme. In some embodiments, the CRISPR enzyme is a Cas13 enzyme. In some embodiments, the Cas13 enzyme is derived from *Francisella tularensis* 1, *Francisella tularensis* subsp. *novicida, Prevotella albensis, Lachnospiraceae bacterium* MC2017 1, *Butyrivibrio proteoclasticus, Peregrinibacteria bacterium* GW2011 GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens*, or *Porphyromonas macacae* Cas13 (e.g., modified to have or be associated with at least one DD), and may include further alteration or mutation of the Cas13, and can be a chimeric Cas13. In some embodiments, the DD-CRISPR enzyme is codon-optimized for expression in a eukaryotic cell. In some embodiments, the DD-CRISPR enzyme directs cleavage of one or two strands at the location of the target sequence. In some embodiments, the DD-CRISPR enzyme lacks or substantially DNA strand cleavage activity (e.g., no more than 5% nuclease activity as compared with a wild type enzyme or enzyme not having the mutation or alteration that decreases nuclease activity). In some embodiments, the first regulatory element is a polymerase III promoter. In some embodiments, the second regulatory element is a polymerase II promoter. In some embodiments, the guide sequence is at least 16, 17, 18, 19, 20, 25 nucleotides, or between 16-30, or between 16-25, or between 16-20 nucleotides in length.

In one aspect, the invention provides a method of modifying multiple target polynucleotides in a host cell such as a eukaryotic cell. In some embodiments, the method comprises allowing a Cas13 CRISPR complex to bind to multiple target polynucleotides, e.g., to effect cleavage of said multiple target polynucleotides, thereby modifying multiple target polynucleotides, wherein the Cas13 CRISPR complex comprises a Cas13 enzyme complexed with multiple guide sequences each of the being hybridized to a specific target sequence within said target polynucleotide, wherein said multiple guide sequences are linked to a direct repeat sequence. Where applicable, a tracr sequence may also be provided (e.g. to provide a single guide RNA, sgRNA). In some embodiments, said cleavage comprises cleaving one or two strands at the location of each of the target sequence by said Cas13 enzyme. In some embodiments, said cleavage results in decreased transcription of the multiple target genes. In some embodiments, the method further comprises repairing one or more of said cleaved target polynucleotide by homologous recombination with an exogenous template polynucleotide, wherein said repair results in a mutation comprising an insertion, deletion, or substitution of one or more nucleotides of one or more of said target polynucleotides. In some embodiments, said mutation results in one or more amino acid changes in a protein expressed from a gene comprising one or more of the target sequence(s). In some embodiments, the method further comprises delivering one or more vectors to said eukaryotic cell, wherein the one or more vectors drive expression of one or more of: the Cas13 enzyme and the multiple guide RNA sequence linked to a direct repeat sequence. Where applicable, a tracr sequence may also be provided. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of multiple polynucleotides in a eukaryotic cell. In some embodiments, the method comprises allowing a Cas13 CRISPR complex to bind to multiple polynucleotides such that said binding results in increased or decreased expression of said polynucleotides; wherein the Cas13 CRISPR complex comprises a Cas13 enzyme complexed with multiple guide sequences each specifically hybridized to its own target sequence within said polynucleotide, wherein said guide sequences are linked to a direct repeat sequence. Where applicable, a tracr sequence may also be provided. In some embodiments, the method further comprises delivering one or more vectors to said eukaryotic cells, wherein the one or more vectors drive expression of one or more of: the Cas13 enzyme and the multiple guide sequences linked to the direct repeat sequences. Where applicable, a tracr sequence may also be provided.

In one aspect, the invention provides a recombinant polynucleotide comprising multiple guide RNA sequences up- or downstream (whichever applicable) of a direct repeat sequence, wherein each of the guide sequences when expressed directs sequence-specific binding of a Cas13 CRISPR complex to its corresponding target sequence present in a eukaryotic cell. In some embodiments, the target sequence is a viral sequence present in a eukaryotic cell. Where applicable, a tracr sequence may also be provided. In some embodiments, the target sequence is a proto-oncogene or an oncogene.

Aspects of the invention encompass a non-naturally occurring or engineered composition that may comprise a guide RNA (gRNA) comprising a guide sequence capable of hybridizing to a target sequence in a genomic locus of interest in a cell and a Cas13 enzyme as defined herein that may comprise at least one or more nuclear localization sequences.

An aspect of the invention encompasses methods of modifying a genomic locus of interest to change gene expression in a cell by introducing into the cell any of the compositions described herein.

An aspect of the invention is that the above elements are comprised in a single composition or comprised in individual compositions. These compositions may advantageously be applied to a host to elicit a functional effect on the genomic level.

As used herein, the term "guide RNA" or "gRNA" has the leaning as used herein elsewhere and comprises any polynucleotide sequence having sufficient complementarity with a target nucleic acid sequence to hybridize with the target nucleic acid sequence and direct sequence-specific binding of a nucleic acid-targeting complex to the target nucleic acid sequence. Each gRNA may be designed to include multiple binding recognition sites (e.g., aptamers) specific to the same or different adapter protein. Each gRNA may be designed to bind to the promoter region −1000-+1 nucleic acids upstream of the transcription start site (i.e. TSS), preferably −200 nucleic acids. This positioning improves functional domains which affect gene activation (e.g., transcription activators) or gene inhibition (e.g., transcription repressors). The modified gRNA may be one or more modified gRNAs targeted to one or more target loci (e.g., at least 1 gRNA, at least 2 gRNA, at least 5 gRNA, at least 10 gRNA, at least 20 gRNA, at least 30 g RNA, at least 50 gRNA) comprised in a composition. Said multiple gRNA sequences can be tandemly arranged and are preferably separated by a direct repeat.

Thus, gRNA, the CRISPR enzyme as defined herein may each individually be comprised in a composition and administered to a host individually or collectively. Alternatively, these components may be provided in a single composition for administration to a host. Administration to a host may be performed via viral vectors known to the skilled person or described herein for delivery to a host (e.g., lentiviral vector, adenoviral vector, AAV vector). As explained herein, use of different selection markers (e.g., for lentiviral sgRNA selection) and concentration of gRNA (e.g., dependent on whether multiple gRNAs are used) may be advantageous for eliciting an improved effect. On the basis of this concept, several variations are appropriate to elicit a genomic locus event, including DNA cleavage, gene activation, or gene deactivation. Using the provided compositions, the person skilled in the art can advantageously and specifically target single or multiple loci with the same or different functional domains to elicit one or more genomic locus events. The compositions may be applied in a wide variety of methods for screening in libraries in cells and functional modeling in vivo (e.g., gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR transgenic cell/animals; see, e.g., Platt et al., Cell (2014), 159(2): 440-455, or PCT patent publications cited herein, such as WO 2014/093622 (PCT/US2013/074667). For example, cells or animals such as non-human animals, e.g., vertebrates or mammals, such as rodents, e.g., mice, rats, or other laboratory or field animals, e.g., cats, dogs, sheep, etc., may be 'knock-in' whereby the animal conditionally or inducibly expresses Cas13 akin to Platt et al. The target cell or animal thus comprises the CRISPR enzyme (e.g., Cas13) conditionally or inducibly (e.g., in the form of Cre dependent constructs), on expression of a vector introduced into the target cell, the vector expresses that which induces or gives rise to the condition of the CRISPR enzyme (e.g., Cas13) expression in the target cell. By applying the teaching and compositions as defined herein with the known method of creating a CRISPR complex, inducible genomic events are also an aspect of the current invention. Examples of such inducible events have been described herein elsewhere.

In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin-HBB (for treating Sickle Cell Anemia, including by stimulating gene-conversion (using closely related HBD gene as an endogenous template)); CD3 (T-Cells); and CEP920-retina (eye).

In some embodiments disease targets also include: cancer; Sickle Cell Anemia (based on a point mutation); HBV, HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

Methods, products and uses described herein may be used for non-therapeutic purposes. Furthermore, any of the methods described herein may be applied in vitro and ex vivo.

In an aspect, provided is a non-naturally occurring or engineered composition comprising:

I. two or more CRISPR-Cas system polynucleotide sequences comprising
   (a) a first guide sequence capable of hybridizing to a first target sequence in a polynucleotide locus,
   (b) a second guide sequence capable of hybridizing to a second target sequence in a polynucleotide locus,
   (c) a direct repeat sequence,
   and II. a Cas13 enzyme or a second polynucleotide sequence encoding it, wherein when transcribed, the first and the second guide sequences direct sequence-specific binding of a first and a second Cas13 CRISPR complex to the first and second target sequences respectively, wherein the first CRISPR complex comprises the Cas13 enzyme complexed with the first guide sequence that is hybridizable to the first target sequence, wherein the second CRISPR complex comprises the Cas13 enzyme complexed with the second guide sequence that is hybridizable to the second target sequence, and wherein the first guide sequence directs cleavage of one strand of the DNA duplex near the first target sequence and the second guide sequence directs cleavage of the other strand near the second target sequence inducing a double strand break, thereby modifying the organism or the non-human or non-animal organism. Similarly, compositions comprising more than two guide RNAs can be envisaged e.g. each specific for one target, and arranged tandemly in the composition or CRISPR system or complex as described herein.

In another embodiment, the Cas13 is delivered into the cell as a protein. In another and particularly preferred embodiment, the Cas13 is delivered into the cell as a protein or as a nucleotide sequence encoding it. Delivery to the cell as a protein may include delivery of a Ribonucleoprotein (RNP) complex, where the protein is complexed with the multiple guides.

In an aspect, host cells and cell lines modified by or comprising the compositions, systems or modified enzymes of present invention are provided, including stem cells, and progeny thereof.

In an aspect, methods of cellular therapy are provided, where, for example, a single cell or a population of cells is sampled or cultured, wherein that cell or cells is or has been modified ex vivo as described herein, and is then re-introduced (sampled cells) or introduced (cultured cells) into the organism. Stem cells, whether embryonic or induce pluripotent or totipotent stem cells, are also particularly preferred in this regard. But, of course, in vivo embodiments are also envisaged.

Inventive methods can further comprise delivery of templates, such as repair templates, which may be dsODN or ssODN, see below. Delivery of templates may be via the cotemporaneous or separate from delivery of any or all the CRISPR enzyme or guide RNAs and via the same delivery mechanism or different. In some embodiments, it is preferred that the template is delivered together with the guide RNAs and, preferably, also the CRISPR enzyme. An example may be an AAV vector where the CRISPR enzyme is AsCas or LbCas.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or –(b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

The invention also comprehends products obtained from using CRISPR enzyme or Cas enzyme or Cas13 enzyme or CRISPR-CRISPR enzyme or CRISPR-Cas system or CRISPR-Cas13 system for use in tandem or multiple targeting as defined herein.

Escorted Guides for the Cas13 CRISPR-Cas System According to the Invention

In one aspect the invention provides escorted Cas13 CRISPR-Cas systems or complexes, especially such a system involving an escorted Cas13 CRISPR-Cas system guide. By "escorted" is meant that the Cas13 CRISPR-Cas system or complex or guide is delivered to a selected time or place within a cell, so that activity of the Cas13 CRISPR-Cas system or complex or guide is spatially or temporally controlled. For example, the activity and destination of the Cas13 CRISPR-Cas system or complex or guide may be controlled by an escort RNA aptamer sequence that has binding affinity for an aptamer ligand, such as a cell surface protein or other localized cellular component. Alternatively, the escort aptamer may for example be responsive to an aptamer effector on or in the cell, such as a transient effector, such as an external energy source that is applied to the cell at a particular time.

The escorted Cas13 CRISPR-Cas systems or complexes have a gRNA with a functional structure designed to improve gRNA structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928). Aptamers may also be constructed that function as molecular switches, responding to a que by changing properties, such as RNA aptamers that bind fluorophores to mimic the activity of green fluorescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, provided herein is a gRNA modified, e.g., by one or more aptamer(s) designed to improve gRNA delivery, including delivery across the cellular membrane, to intracellular compartments, or into the nucleus. Such a structure can include, either in addition to the one or more aptamer(s) or without such one or more aptamer(s), moiety (ies) so as to render the guide deliverable, inducible or responsive to a selected effector. The invention accordingly comprehends an gRNA that responds to normal or pathological physiological conditions, including without limitation pH, hypoxia, 02 concentration, temperature, protein concentration, enzymatic concentration, lipid structure, light exposure, mechanical disruption (e.g. ultrasound waves), magnetic fields, electric fields, or electromagnetic radiation.

An aspect of the invention provides non-naturally occurring or engineered composition comprising an escorted guide RNA (egRNA) comprising:

an RNA guide sequence capable of hybridizing to a target sequence in a genomic locus of interest in a cell; and, an escort RNA aptamer sequence, wherein the escort aptamer has binding affinity for an aptamer ligand on or in the cell, or the escort aptamer is responsive to a localized aptamer effector on or in the cell, wherein the presence of the aptamer ligand or effector on or in the cell is spatially or temporally restricted.

The escort aptamer may for example change conformation in response to an interaction with the aptamer ligand or effector in the cell.

The escort aptamer may have specific binding affinity for the aptamer ligand.

The aptamer ligand may be localized in a location or compartment of the cell, for example on or in a membrane of the cell. Binding of the escort aptamer to the aptamer ligand may accordingly direct the egRNA to a location of interest in the cell, such as the interior of the cell by way of binding to an aptamer ligand that is a cell surface ligand. In this way, a variety of spatially restricted locations within the cell may be targeted, such as the cell nucleus or mitochondria.

Once intended alterations have been introduced, such as by editing intended copies of a gene in the genome of a cell, continued CRISPR/Cas13 expression in that cell is no longer necessary. Indeed, sustained expression would be undesirable in certain casein case of off-target effects at unintended genomic sites, etc. Thus time-limited expression would be useful. Inducible expression offers one approach, but in addition Applicants have engineered a Self-Inactivating Cas13 CRISPR-Cas system that relies on the use of a non-coding guide target sequence within the CRISPR vector itself. Thus, after expression begins, the CRISPR system will lead to its own destruction, but before destruction is complete it will have time to edit the genomic copies of the target gene (which, with a normal point mutation in a diploid cell, requires at most two edits). Simply, the self inactivating Cas13 CRISPR-Cas system includes additional RNA (i.e., guide RNA) that targets the coding sequence for the CRISPR enzyme itself or that targets one or more non-coding guide target sequences complementary to unique sequences present in one or more of the following: (a) within the promoter driving expression of the non-coding RNA elements, (b) within the promoter driving expression of the Cas13 gene, (c) within 100 bp of the ATG translational start codon in the Cas13 coding sequence, (d) within the inverted terminal repeat (iTR) of a viral delivery vector, e.g., in an AAV genome.

The egRNA may include an RNA aptamer linking sequence, operably linking the escort RNA sequence to the RNA guide sequence.

In embodiments, the egRNA may include one or more photolabile bonds or non-naturally occurring residues.

In one aspect, the escort RNA aptamer sequence may be complementary to a target miRNA, which may or may not be present within a cell, so that only when the target miRNA is present is there binding of the escort RNA aptamer sequence to the target miRNA which results in cleavage of the egRNA by an RNA-induced silencing complex (RISC) within the cell.

In embodiments, the escort RNA aptamer sequence may for example be from 10 to 200 nucleotides in length, and the egRNA may include more than one escort RNA aptamer sequence.

It is to be understood that any of the RNA guide sequences as described herein elsewhere can be used in the egRNA described herein. In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In certain embodiments the guide RNA or mature crRNA comprises 19 nts of partial direct repeat followed by 23-25 nt of guide sequence or spacer sequence. In certain embodiments, the effector protein is a FnCas13 effector protein and requires at least 16 nt of guide sequence to achieve detectable DNA cleavage and a minimum of 17 nt of guide sequence to achieve efficient DNA cleavage in vitro. In certain embodiments, the direct repeat sequence is located upstream (i.e., 5') from the guide sequence or spacer sequence. In a preferred embodiment the seed sequence (i.e. the sequence essential critical for recognition and/or hybridization to the sequence at the target locus) of the FnCas13 guide RNA is approximately within the first 5 nt on the 5' end of the guide sequence or spacer sequence.

The egRNA may be included in a non-naturally occurring or engineered Cas13 CRISPR-Cas complex composition, together with a Cas13 which may include at least one mutation, for example a mutation so that the Cas13 has no more than 5% of the nuclease activity of a Cas13 not having the at least one mutation, for example having a diminished nuclease activity of at least 97%, or 100% as compared with the Cas13 not having the at least one mutation. The Cas13 may also include one or more nuclear localization sequences. Mutated Cas13 enzymes having modulated activity such as diminished nuclease activity are described herein elsewhere.

The engineered Cas13 CRISPR-Cas composition may be provided in a cell, such as a eukaryotic cell, a mammalian cell, or a human cell.

In embodiments, the compositions described herein comprise a Cas13 CRISPR-Cas complex having at least three functional domains, at least one of which is associated with Cas13 and at least two of which are associated with egRNA.

The compositions described herein may be used to introduce a genomic locus event in a host cell, such as a eukaryotic cell, in particular a mammalian cell, or a non-human eukaryote, in particular a non-human mammal such as a mouse, in vivo. The genomic locus event may comprise affecting gene activation, gene inhibition, or cleavage in a locus. The compositions described herein may also be used to modify a genomic locus of interest to change gene expression in a cell. Methods of introducing a genomic locus event in a host cell using the Cas13 enzyme provided herein are described herein in detail elsewhere. Delivery of the composition may for example be by way of delivery of a nucleic acid molecule(s) coding for the composition, which nucleic acid molecule(s) is operatively linked to regulatory sequence(s), and expression of the nucleic acid molecule(s) in vivo, for example by way of a lentivirus, an adenovirus, or an AAV.

The present invention provides compositions and methods by which gRNA-mediated gene editing activity can be adapted. The invention provides gRNA secondary structures that improve cutting efficiency by increasing gRNA and/or increasing the amount of RNA delivered into the cell. The gRNA may include light labile or inducible nucleotides.

To increase the effectiveness of gRNA, for example gRNA delivered with viral or non-viral technologies, Applicants added secondary structures into the gRNA that enhance its stability and improve gene editing. Separately, to overcome the lack of effective delivery, Applicants modified gRNAs with cell penetrating RNA aptamers; the aptamers bind to cell surface receptors and promote the entry of gRNAs into cells. Notably, the cell-penetrating aptamers can be designed to target specific cell receptors, in order to mediate cell-specific delivery. Applicants also have created guides that are inducible.

Light responsiveness of an inducible system may be achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Crytochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm2. In a preferred embodiment, a stimulation paradigm of as low as 0.25 sec every 15 sec should result in maximal activation.

Cells involved in the practice of the present invention may be a prokaryotic cell or a eukaryotic cell, advantageously an animal cell a plant cell or a yeast cell, more advantageously a mammalian cell.

The chemical or energy sensitive guide may undergo a conformational change upon induction by the binding of a chemical source or by the energy allowing it act as a guide and have the Cas13 CRISPR-Cas system or complex function. The invention can involve applying the chemical source or energy so as to have the guide function and the Cas13 CRISPR-Cas system or complex function; and optionally further determining that the expression of the genomic locus is altered.

There are several different designs of this chemical inducible system: 1. ABI-PYL based system inducible by Abscisic Acid (ABA) (see, e.g., stke.sciencemag.org/cgi/content/abstract/sigtrans; 4/164/rs2), 2. FKBP-FRB based system inducible by rapamycin (or related chemicals based on rapamycin) (see, e.g., www.nature.com/nmeth/journal/v2/n6/full/nmeth763.html), 3. GID1-GAI based system inducible by Gibberellin (GA) (see, e.g., www.nature.com/nchembio/journal/v8/n5/full/nchembio.922.html).

Another system contemplated by the present invention is a chemical inducible system based on change in sub-cellular localization. Applicants also developed a system in which the polypeptide include a DNA binding domain comprising at least five or more Transcription activator-like effector (TALE) monomers and at least one or more half-monomers specifically ordered to target the genomic locus of interest linked to at least one or more effector domains are further linker to a chemical or energy sensitive protein. This protein will lead to a change in the sub-cellular localization of the entire polypeptide (i.e. transportation of the entire polypeptide from cytoplasm into the nucleus of the cells) upon the binding of a chemical or energy transfer to the chemical or energy sensitive protein. This transportation of the entire polypeptide from one sub-cellular compartments or organelles, in which its activity is sequestered due to lack of substrate for the effector domain, into another one in which the substrate is present would allow the entire polypeptide to come in contact with its desired substrate (i.e. genomic DNA in the mammalian nucleus) and result in activation or repression of target gene expression.

This type of system could also be used to induce the cleavage of a genomic locus of interest in a cell when the effector domain is a nuclease.

A chemical inducible system can be an estrogen receptor (ER) based system inducible by 4-hydroxytamoxifen (4OHT) (see, e.g., www.pnas.org/content/104/3/1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogen receptor, estrogen-related receptor, glucocorticoid receptor, progesterone receptor, androgen receptor may be used in inducible systems analogous to the ER based inducible system.

Another inducible system is based on the design using Transient receptor potential (TRP) ion channel based system inducible by energy, heat or radio-wave (see, e.g., www.sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the Cas13 CRISPR-Cas complex or system, and the binding will induce the change of sub-cellular localization of the polypeptide, leading to the entire polypeptide entering the nucleus of cells. Once inside the nucleus, the guide protein and the other components of the Cas13 CRISPR-Cas complex will be active and modulating target gene expression in cells.

This type of system could also be used to induce the cleavage of a genomic locus of interest in a cell; and, in this regard, it is noted that the Cas13 enzyme is a nuclease. The light could be generated with a laser or other forms of energy sources. The heat could be generated by raise of temperature results from an energy source, or from nano-particles that release heat after absorbing energy from an energy source delivered in the form of radio-wave.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 kVolts/cm under in vivo conditions. Instead of or in addition to the pulses, the electric field may be delivered in a continuous manner. The electric pulse may be applied for between 1¬μs and 500 milliseconds, preferably between 1¬μs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 kVolts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include reference the presence of an electric potential difference in the environment of a cell. Such an environment may be set up by way of static electricity, alternating current (AC), direct current (DC), etc, as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326).

The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100. mu.s duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between 1V/cm and 20V/cm, for a period of 100 milliseconds or more, preferably 15 minutes or more.

Ultrasound is advantageously administered at a power level of from about 0.05 W/cm2 to about 100 W/cm2. Diagnostic or therapeutic ultrasound may be used, or combinations thereof.

As used herein, the term "ultrasound" refers to a form of energy which consists of mechanical vibrations the frequencies of which are so high they are above the range of human hearing. Lower frequency limit of the ultrasonic spectrum may generally be taken as about 20 KHz. Most diagnostic applications of ultrasound employ frequencies in the range 1 and 15 MHz' (From Ultrasonics in Clinical Diagnosis, P. N. T. Wells, ed., $2^{nd}$. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm2 (FDA recommendation), although energy densities of up to 750 mW/cm2 have been used. In physiotherapy, ultrasound is typically used as an energy source in a range up to about 3 to 4 W/cm2 (WHO recommendation). In other therapeutic applications, higher intensities of ultrasound may be employed, for example, HIFU at 100 W/cm up to 1 kW/cm2 (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142. Another form of focused ultrasound is high intensity focused ultrasound (HIFU) which is reviewed by Moussatov et al in Ultrasonics (1998) Vol. 36, No. 8, pp. 893-900 and TranHuuHue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm-2. Even more preferably, the exposure to an ultrasound energy source is at a power density of from about 1 to about 15 Wcm-2.

Preferably the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes.

Advantageously, the target tissue is exposed to an ultrasound energy source at an acoustic power density of from about 0.05 Wcm-2 to about 10 Wcm-2 with a frequency ranging from about 0.015 to about 10 MHz (see WO 98/52609). However, alternatives are also possible, for example, exposure to an ultrasound energy source at an acoustic power density of above 100 Wcm-2, but for reduced periods of time, for example, 1000 Wcm-2 for periods in the millisecond range or less.

Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 Wcm-2 or 1.25 Wcm-2 as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as but not limited to a lobe of the liver) or whole organ (such as but not limited to the entire liver or an entire muscle, such as the heart) therapy. Another important advantage is that ultrasound is a non-invasive stimulus which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

The rapid transcriptional response and endogenous targeting of the instant invention make for an ideal system for the study of transcriptional dynamics. For example, the instant invention may be used to study the dynamics of variant production upon induced expression of a target gene. On the other end of the transcription cycle, mRNA degradation studies are often performed in response to a strong extracellular stimulus, causing expression level changes in a plethora of genes. The instant invention may be utilized to reversibly induce transcription of an endogenous target, after which point stimulation may be stopped and the degradation kinetics of the unique target may be tracked.

The temporal precision of the instant invention may provide the power to time genetic regulation in concert with experimental interventions. For example, targets with suspected involvement in long-term potentiation (LTP) may be modulated in organotypic or dissociated neuronal cultures, but only during stimulus to induce LTP, so as to avoid interfering with the normal development of the cells. Similarly, in cellular models exhibiting disease phenotypes, targets suspected to be involved in the effectiveness of a particular therapy may be modulated only during treatment. Conversely, genetic targets may be modulated only during a pathological stimulus. Any number of experiments in which timing of genetic cues to external experimental stimuli is of relevance may potentially benefit from the utility of the instant invention.

The in vivo context offers equally rich opportunities for the instant invention to control gene expression. Photoinducibility provides the potential for spatial precision. Taking advantage of the development of optrode technology, a stimulating fiber optic lead may be placed in a precise brain region. Stimulation region size may then be tuned by light intensity. This may be done in conjunction with the delivery of the Cas13 CRISPR-Cas system or complex of the invention, or, in the case of transgenic Cas13 animals, guide RNA of the invention may be delivered and the optrode technology can allow for the modulation of gene expression in precise brain regions. A transparent Cas13 expressing organism, can have guide RNA of the invention administered to it and then there can be extremely precise laser induced local gene expression changes.

A culture medium for culturing host cells includes a medium commonly used for tissue culture, such as M199-earle base, Eagle MEM (E-MEM), Dulbecco MEM (DMEM), SC-UCM102, UP-SFM (GIBCO BRL), EX-CELL302 (Nichirei), EX-CELL293-S(Nichirei), TFBM-01 (Nichirei), ASF104, among others. Suitable culture media for specific cell types may be found at the American Type Culture Collection (ATCC) or the European Collection of Cell Cultures (ECACC). Culture media may be supplemented with amino acids such as L-glutamine, salts, anti-fungal or anti-bacterial agents such as Fungizone-Æ, penicillin-streptomycin, animal serum, and the like. The cell culture medium may optionally be serum-free.

The invention may also offer valuable temporal precision in vivo. The invention may be used to alter gene expression during a particular stage of development. The invention may be used to time a genetic cue to a particular experimental window. For example, genes implicated in learning may be overexpressed or repressed only during the learning stimulus in a precise region of the intact rodent or primate brain. Further, the invention may be used to induce gene expression changes only during particular stages of disease development. For example, an oncogene may be overexpressed only once a tumor reaches a particular size or metastatic stage. Conversely, proteins suspected in the development of Alzheimer's may be knocked down only at defined time points in the animal's life and within a particular brain region. Although these examples do not exhaustively list the potential applications of the invention, they highlight some of the areas in which the invention may be a powerful technology.

Protected Guides: Enzymes According to the Invention can be Used in Combination with Protected Guide RNAs In one aspect, an object of the current invention is to further enhance the specificity of Cas13 given individual guide RNAs through thermodynamic tuning of the binding specificity of the guide RNA to target DNA. This is a general approach of introducing mismatches, elongation or truncation of the guide sequence to increase/decrease the number of complimentary bases vs. mismatched bases shared between a genomic target and its potential off-target loci, in order to give thermodynamic advantage to targeted genomic loci over genomic off-targets.

In one aspect, the invention provides for the guide sequence being modified by secondary structure to increase the specificity of the Cas13 CRISPR-Cas system and whereby the secondary structure can protect against exonuclease activity and allow for 3' additions to the guide sequence.

In one aspect, the invention provides for hybridizing a "protector RNA" to a guide sequence, wherein the "protector RNA" is an RNA strand complementary to the 5' end of the guide RNA (gRNA), to thereby generate a partially double-stranded gRNA. In an embodiment of the invention, protecting the mismatched bases with a perfectly complementary protector sequence decreases the likelihood of target DNA binding to the mismatched base pairs at the 3' end. In embodiments of the invention, additional sequences comprising an extended length may also be present.

Guide RNA (gRNA) extensions matching the genomic target provide gRNA protection and enhance specificity. Extension of the gRNA with matching sequence distal to the end of the spacer seed for individual genomic targets is envisaged to provide enhanced specificity. Matching gRNA extensions that enhance specificity have been observed in cells without truncation. Prediction of gRNA structure accompanying these stable length extensions has shown that stable forms arise from protective states, where the extension forms a closed loop with the gRNA seed due to complimentary sequences in the spacer extension and the spacer seed. These results demonstrate that the protected guide concept also includes sequences matching the genomic target sequence distal of the 20mer spacer-binding region. Thermodynamic prediction can be used to predict completely matching or partially matching guide extensions that result in protected gRNA states. This extends the concept of protected gRNAs to interaction between X and Z, where X will generally be of length 17-20 nt and Z is of length 1-30 nt. Thermodynamic prediction can be used to determine the optimal extension state for Z, potentially introducing small numbers of mismatches in Z to promote the formation of protected conformations between X and Z. Throughout the present application, the terms "X" and seed length (SL) are used interchangeably with the term exposed length (EpL) which denotes the number of nucleotides available for target DNA to bind; the terms "Y" and protector length (PL) are used interchangeably to represent the length of the protector; and the terms "Z", "E", "E" and "EL" are used interchangeably to correspond to the term extended length (ExL) which represents the number of nucleotides by which the target sequence is extended.

An extension sequence which corresponds to the extended length (ExL) may optionally be attached directly to the guide sequence at the 3' end of the protected guide sequence. The extension sequence may be 2 to 12 nucleotides in length. Preferably ExL may be denoted as 0, 2, 4, 6, 8, 10 or 12 nucleotides in length. In a preferred embodiment the ExL is denoted as 0 or 4 nucleotides in length. In a more preferred embodiment the ExL is 4 nucleotides in length. The extension sequence may or may not be complementary to the target sequence.

An extension sequence may further optionally be attached directly to the guide sequence at the 5' end of the protected guide sequence as well as to the 3' end of a protecting sequence. As a result, the extension sequence serves as a linking sequence between the protected sequence and the protecting sequence. Without wishing to be bound by theory, such a link may position the protecting sequence near the protected sequence for improved binding of the protecting sequence to the protected sequence. It will be understood that the above-described relationship of seed, protector, and extension applies where the distal end (i.e., the targeting end) of the guide is the 5' end, e.g. a guide that functions is a Cas13 system. In an embodiment wherein the distal end of the guide is the 3' end, the relationship will be the reverse. In such an embodiment, the invention provides for hybridizing a "protector RNA" to a guide sequence, wherein the "protector RNA" is an RNA strand complementary to the 3' end of the guide RNA (gRNA), to thereby generate a partially double-stranded gRNA.

Addition of gRNA mismatches to the distal end of the gRNA can demonstrate enhanced specificity. The introduction of unprotected distal mismatches in Y or extension of the gRNA with distal mismatches (Z) can demonstrate enhanced specificity. This concept as mentioned is tied to X, Y, and Z components used in protected gRNAs. The unprotected mismatch concept may be further generalized to the concepts of X, Y, and Z described for protected guide RNAs.

Cas13. In one aspect, the invention provides for enhanced Cas13 specificity wherein the double stranded 3' end of the protected guide RNA (pgRNA) allows for two possible outcomes: (1) the guide RNA-protector RNA to guide RNA-target DNA strand exchange will occur and the guide will fully bind the target, or (2) the guide RNA will fail to fully bind the target and because Cas13 target cleavage is a multiple step kinetic reaction that requires guide RNA: target DNA binding to activate Cas13-catalyzed DSBs, wherein Cas13 cleavage does not occur if the guide RNA does not properly bind. According to particular embodiments, the protected guide RNA improves specificity of target binding as compared to a naturally occurring CRISPR-Cas system. According to particular embodiments the protected modified guide RNA improves stability as compared to a naturally occurring CRISPR-Cas. According to particular embodiments the protector sequence has a length between 3 and 120 nucleotides and comprises 3 or more contiguous nucleotides complementary to another sequence of guide or protector. According to particular embodiments, the protector sequence forms a hairpin. According to particular embodiments the guide RNA further comprises a protected sequence and an exposed sequence. According to particular embodiments the exposed sequence is 1 to 19 nucleotides. More particularly, the exposed sequence is at least 75%, at least 90% or about 100% complementary to the target sequence. According to particular embodiments the guide sequence is at least 90% or about 100% complementary to the protector strand. According to particular embodiments the guide sequence is at least 75%, at least 90% or about 100% complementary to the target sequence. According to particular embodiments, the guide RNA further comprises an extension sequence. More particularly, when the distal end of the guide is the 3' end, the extension sequence is operably linked to the 3' end of the protected guide sequence, and optionally directly linked to the 3' end of the protected guide sequence. According to particular embodiments the extension sequence is 1-12 nucleotides. According to particular embodiments the extension sequence is operably linked to the guide sequence at the 3' end of the protected guide sequence and the 5' end of the protector strand and optionally directly linked to the 3' end of the protected guide sequence and the 53' end of the protector strand, wherein the extension sequence is a linking sequence between the protected sequence and the protector strand. According to particular embodiments the extension sequence is 100% not complementary to the protector strand, optionally at least 95%, at least 90%, at least 80%, at least 70%, at least 60%, or at least 50% not complementary to the protector strand. According to particular embodiments the guide sequence further comprises mismatches appended to the end of the guide sequence, wherein the mismatches thermodynamically optimize specificity.

According to the invention, in certain embodiments, guide modifications that impede strand invasion will be desireable. For example, to minimize off-target actifity, in certain embodiments, it will be desireable to design or modify a guide to impede strand invasiom at off-target sites. In certain such embodiments, it may be acceptable or useful to design or modify a guide at the expense of on-target binding efficiency. In certain embodiments, guide-target mismatches at the target site may be tolerated that substantially reduce off-target activity.

In certain embodiments of the invention, it is desirable to adjust the binding characteristics of the protected guide to minimize off-target CRISPR activity. Accordingly, thermodynamic prediction algorithms are used to predict strengths of binding on target and off target. Alternatively or in addition, selection methods are used to reduce or minimize off-target effects, by absolute measures or relative to on-target effects.

Design options include, without limitation, i) adjusting the length of protector strand that binds to the protected strand, ii) adjusting the length of the portion of the protected strand that is exposed, iii) extending the protected strand with a stem-loop located external (distal) to the protected strand (i.e. designed so that the stem loop is external to the protected strand at the distal end), iv) extending the protected strand by addition of a protector strand to form a stem-loop with all or part of the protected strand, v) adjusting binding of the protector strand to the protected strand by designing in one or more base mismatches and/or one or more non-canonical base pairings, vi) adjusting the location of the stem formed by hybridization of the protector strand to the protected strand, and vii) addition of a non-structured protector to the end of the protected strand.

In one aspect, the invention provides an engineered, non-naturally occurring CRISPR-Cas system comprising a Cas13 protein and a protected guide RNA that targets a DNA molecule encoding a gene product in a cell, whereby the protected guide RNA targets the DNA molecule encoding the gene product and the Cas13 protein cleaves the DNA molecule encoding the gene product, whereby expression of the gene product is altered; and, wherein the Cas13 protein and the protected guide RNA do not naturally occur together. The invention comprehends the protected guide RNA comprising a guide sequence fused 3' to a direct repeat sequence. The invention further comprehends the Cas13 CRISPR protein being codon optimized for expression in a eEukaryotic cell. In a preferred embodiment the eEukaryotic cell is a mammalian cell, a plant cell or a yeast cell and in a more preferred embodiment the mammalian cell is a human cell. In a further embodiment of the invention, the expression of the gene product is decreased. In some embodiments the CRISPR protein is Cas13. In some embodiments the CRISPR protein is Cas12a. In some embodiments, the Cas13 or Cas12a enzyme protein is *Acidaminococcus* sp. BV3L6, *Lachnospiraceae bacterium* or *Francisella Novicida* Cas13 or Cas12a, and may include mutated Cas13 or Cas12a derived from these organisms. The enzyme protein may be a further Cas13 or Cas12a homolog or ortholog. In some embodiments, the nucleotide sequence encoding the Cfp1 Csa13 or Cas12a enzyme protein is codon-optimized for expression in a eukaryotic cell. In some embodiments, the Cas13 or Cas12a enzyme protein directs cleavage of one or two strands at the location of the target sequence. In some embodiments, the first regulatory element is a polymerase III promoter. In some embodiments, the second regulatory element is a polymerase II promoter. In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

Advantageous vectors include lentiviruses and adeno-associated viruses, and types of such vectors can also be selected for targeting particular types of cells.

In one aspect, the invention provides a eukaryotic host cell comprising (a) a first regulatory element operably linked to a direct repeat sequence and one or more insertion sites for inserting one or more guide sequences downstream of the direct repeat sequence, wherein when expressed, the guide sequence directs sequence-specific binding of a CRISPR complex to a target sequence in a eukaryotic cell, wherein the CRISPR complex comprises a CRISPR enzyme complexed with the guide RNA comprising the guide sequence that is hybridized to the target sequence and/or (b) a second regulatory element operably linked to an enzyme-coding sequence encoding said Cas13 enzyme comprising a nuclear localization sequence. In some embodiments, the host cell comprises components (a) and (b). In some embodiments, component (a), component (b), or components (a) and (b) are stably integrated into a genome of the host eukaryotic cell. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the Cas13 enzyme directs cleavage of one or two strands at the location of the target sequence. In some embodiments, the Cas13 enzyme lacks RNA strand cleavage activity. In some embodiments, the first regulatory element is a polymerase III promoter. In some embodiments, the second regulatory element is a polymerase II promoter.

In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The organism also may be a plant or a yeast. Further, the organism may be a fungus.

In one aspect, the invention provides a kit comprising one or more of the components described herein above. In some embodiments, the kit comprises a vector system and instructions for using the kit. In some embodiments, the vector system comprises (a) a first regulatory element operably linked to a direct repeat sequence and one or more insertion sites for inserting one or more guide sequences downstream of the direct repeat sequence, wherein when expressed, the guide sequence directs sequence-specific binding of a Cas13 CRISPR complex to a target sequence in a eukaryotic cell, wherein the CRISPR complex comprises a Cas13 enzyme complexed with the protected guide RNA comprising the guide sequence that is hybridized to the target sequence and/or (b) a second regulatory element operably linked to an enzyme-coding sequence encoding said Cas13 enzyme comprising a nuclear localization sequence. In some embodiments, the kit comprises components (a) and (b) located on the same or different vectors of the system. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the Cas13 enzyme comprises one or more nuclear localization sequences of sufficient strength to drive accumulation of said Cas13 enzyme in a detectable amount in the nucleus of a eukaryotic cell. In some embodiments, the Cas13 enzyme is *Acidaminococcus* sp. BV3L6, *Lachnospiraceae bacterium* MA2020 or *Francisella tularensis* 1 *Novicida* Cas13, and may include mutated Cas13 derived from these organisms. The enzyme may be a Cas13 homolog or ortholog. In some embodiments, the CRISPR enzyme is codon-optimized for expression in a eukaryotic cell. In some embodiments, the CRISPR enzyme directs cleavage of one or two strands at the location of the target sequence. In some embodiments, the CRISPR enzyme lacks DNA strand cleavage activity. In some embodiments, the first regulatory element is a polymerase III promoter. In some embodiments, the second regulatory element is a polymerase II promoter.

In one aspect, the invention provides a method of modifying a target polynucleotide in a eukaryotic cell. In some embodiments, the method comprises allowing a CRISPR complex to bind to the target polynucleotide to effect cleavage of said target polynucleotide thereby modifying the target polynucleotide, wherein the CRISPR complex comprises a Cas13 enzyme complexed with protected guide RNA comprising a guide sequence hybridized to a target sequence within said target polynucleotide. In some embodiments, said cleavage comprises cleaving one or two strands at the location of the target sequence by said Cas13 enzyme. In some embodiments, said cleavage results in decreased transcription of a target gene. In some embodiments, the method further comprises repairing said cleaved target polynucleotide by non-homologous end joining (NHEJ)-based gene insertion mechanisms, more particularly with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the Cas13 enzyme, the protected guide RNA comprising the guide sequence linked to direct repeat sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of a polynucleotide in a eukaryotic cell. In some embodiments, the method comprises allowing a Cas13 CRISPR complex to bind to the polynucleotide such that said binding results in increased or decreased expression of said polynucleotide; wherein the CRISPR complex comprises a Cas13 enzyme complexed with a protected guide RNA comprising a guide sequence hybridized to a target sequence within said polynucleotide. In some embodiments, the method further comprises delivering one or more vectors to said eukaryotic cells, wherein the one or more vectors drive expression of one or more of: the Cas13 enzyme and the protected guide RNA.

In one aspect, the invention provides a method of generating a model eukaryotic cell comprising a mutated disease gene. In some embodiments, a disease gene is any gene associated an increase in the risk of having or developing a disease. In some embodiments, the method comprises (a) introducing one or more vectors into a eukaryotic cell, wherein the one or more vectors drive expression of one or more of: a Cas13 enzyme and a protected guide RNA comprising a guide sequence linked to a direct repeat sequence; and (b) allowing a CRISPR complex to bind to a target polynucleotide to effect cleavage of the target polynucleotide within said disease gene, wherein the CRISPR complex comprises the Cas13 enzyme complexed with the guide RNA comprising the sequence that is hybridized to the target sequence within the target polynucleotide, thereby generating a model eukaryotic cell comprising a mutated disease gene. In some embodiments, said cleavage comprises cleaving one or two strands at the location of the target sequence by said Cas13 enzyme. In some embodiments, said cleavage results in decreased transcription of a target gene. In some embodiments, the method further comprises repairing said cleaved target polynucleotide by non-homologous end joining (NHEJ)-based gene insertion mechanisms with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

In one aspect, the invention provides a method for developing a biologically active agent that modulates a cell signaling event associated with a disease gene. In some embodiments, a disease gene is any gene associated an increase in the risk of having or developing a disease. In some embodiments, the method comprises (a) contacting a test compound with a model cell of any one of the described embodiments; and (b) detecting a change in a readout that is indicative of a reduction or an augmentation of a cell signaling event associated with said mutation in said disease gene, thereby developing said biologically active agent that modulates said cell signaling event associated with said disease gene.

In one aspect, the invention provides a recombinant polynucleotide comprising a protected guide sequence downstream of a direct repeat sequence, wherein the protected guide sequence when expressed directs sequence-specific binding of a CRISPR complex to a corresponding target sequence present in a eukaryotic cell. In some embodiments, the target sequence is a viral sequence present in a eukaryotic cell. In some embodiments, the target sequence is a proto-oncogene or an oncogene.

In one aspect the invention provides for a method of selecting one or more cell(s) by introducing one or more mutations in a gene in the one or more cell(s), the method comprising: introducing one or more vectors into the cell(s), wherein the one or more vectors drive expression of one or more of: a Cas13 enzyme, a protected guide RNA comprising a guide sequence, and an editing template; wherein the editing template comprises the one or more mutations that abolish Cas13 enzyme cleavage; allowing non-homologous end joining (NHEJ)-based gene insertion mechanisms of the editing template with the target polynucleotide in the cell(s) to be selected; allowing a CRISPR complex to bind to a target polynucleotide to effect cleavage of the target polynucleotide within said gene, wherein the CRISPR complex comprises the Cas13 enzyme complexed with the protected guide RNA comprising a guide sequence that is hybridized to the target sequence within the target polynucleotide, wherein binding of the CRISPR complex to the target polynucleotide induces cell death, thereby allowing one or more cell(s) in which one or more mutations have been introduced to be selected. In a preferred embodiment of the invention the cell to be selected may be a eukaryotic cell. Aspects of the invention allow for selection of specific cells without requiring a selection marker or a two-step process that may include a counter-selection system.

With respect to mutations of the Cas13 enzyme, when the enzyme is not FnCas13, mutations may be as described herein elsewhere; conservative substitution for any of the replacement amino acids is also envisaged. In an aspect the invention provides as to any or each or all embodiments herein-discussed wherein the CRISPR enzyme comprises at least one or more, or at least two or more mutations, wherein the at least one or more mutation or the at least two or more mutations are selected from those described herein elsewhere.

In a further aspect, the invention involves a computer-assisted method for identifying or designing potential compounds to fit within or bind to CRISPR-Cas13 system or a functional portion thereof or vice versa (a computer-assisted method for identifying or designing potential CRISPR-Cas13 systems or a functional portion thereof for binding to desired compounds) or a computer-assisted method for identifying or designing potential CRISPR-Cas13 systems (e.g., with regard to predicting areas of the CRISPR-Cas13 system to be able to be manipulated—for instance, based on crystal structure data or based on data of Cas13 orthologs, or with respect to where a functional group such as an activator or repressor can be attached to the CRISPR-Cas13 system, or as to Cas13 truncations or as to designing nickases), said method comprising:

using a computer system, e.g., a programmed computer comprising a processor, a data storage system, an input device, and an output device, the steps of:

(a) inputting into the programmed computer through said input device data comprising the three-dimensional co-ordinates of a subset of the atoms from or pertaining to the CRISPR-Cas13 crystal structure, e.g., in the CRISPR-Cas13 system binding domain or alternatively or additionally in domains that vary based on variance among Cas13 orthologs or as to Cas13s or as to nickases or as to functional groups, optionally with structural information from CRISPR-Cas13 system complex(es), thereby generating a data set;

(b) comparing, using said processor, said data set to a computer database of structures stored in said computer data storage system, e.g., structures of compounds that bind or putatively bind or that are desired to bind to a CRISPR-Cas13 system or as to Cas13 orthologs (e.g., as Cas13s or as to domains or regions that vary amongst Cas13 orthologs) or as to the CRISPR-Cas13 crystal structure or as to nickases or as to functional groups;

(c) selecting from said database, using computer methods, structure(s)—e.g., CRISPR-Cas13 structures that may bind to desired structures, desired structures that may bind to certain CRISPR-Cas13 structures, portions of the CRISPR-Cas13 system that may be manipulated, e.g., based on data from other portions of the CRISPR-Cas13 crystal structure and/or from Cas13 orthologs, truncated Cas13s, novel nickases or particular functional groups, or positions for attaching functional groups or functional-group-CRISPR-Cas13 systems;

(d) constructing, using computer methods, a model of the selected structure(s); and (e) outputting to said output device the selected structure(s);

and optionally synthesizing one or more of the selected structure(s);

and further optionally testing said synthesized selected structure(s) as or in a CRISPR-Cas13 system;

or, said method comprising: providing the co-ordinates of at least two atoms of the CRISPR-Cas13 crystal structure, e.g., at least two atoms of the herein Crystal Structure Table of the CRISPR-Cas13 crystal structure or co-ordinates of at least a sub-domain of the CRISPR-Cas13 crystal structure ("selected co-ordinates"), providing the structure of a candidate comprising a binding molecule or of portions of the CRISPR-Cas13 system that may be manipulated, e.g., based on data from other portions of the CRISPR-Cas13 crystal structure and/or from Cas13 orthologs, or the structure of functional groups, and fitting the structure of the candidate to the selected co-ordinates, to thereby obtain product data comprising CRISPR-Cas13 structures that may bind to desired structures, desired structures that may bind to certain CRISPR-Cas13 structures, portions of the CRISPR-Cas13 system that may be manipulated, truncated Cas13s, novel nickases, or particular functional groups, or positions for attaching functional groups or functional-group-CRISPR-Cas13 systems, with output thereof, and optionally synthesizing compound(s) from said product data and further optionally comprising testing said synthesized compound(s) as or in a CRISPR-Cas13 system.

The testing can comprise analyzing the CRISPR-Cas13 system resulting from said synthesized selected structure(s), e.g., with respect to binding, or performing a desired function.

The output in the foregoing methods can comprise data transmission, e.g., transmission of information via telecommunication, telephone, video conference, mass communication, e.g., presentation such as a computer presentation (e.g. POWERPOINT), internet, email, documentary communication such as a computer program (e.g. WORD) document and the like. Accordingly, the invention also comprehends computer readable media containing: atomic co-ordinate data according to the herein-referenced Crystal Structure, said data defining the three dimensional structure of CRISPR-Cas13 or at least one sub-domain thereof, or structure factor data for CRISPR-Cas13, said structure factor data being derivable from the atomic co-ordinate data of herein-referenced Crystal Structure. The computer readable media can also contain any data of the foregoing methods. The invention further comprehends methods a computer system for generating or performing rational design as in the foregoing methods containing either: atomic co-ordinate data according to herein-referenced Crystal Structure, said data defining the three dimensional structure of CRISPR-Cas13 or at least one sub-domain thereof, or structure factor data for CRISPR-Cas13, said structure factor data being derivable from the atomic co-ordinate data of herein-referenced Crystal Structure. The invention further comprehends a method of doing business comprising providing to a user the computer system or the media or the three dimensional structure of CRISPR-Cas13 or at least one sub-domain thereof, or structure factor data for CRISPR-Cas13, said structure set forth in and said structure factor data being derivable from the atomic co-ordinate data of herein-referenced Crystal Structure, or the herein computer media or a herein data transmission.

A "binding site" or an "active site" comprises or consists essentially of or consists of a site (such as an atom, a functional group of an amino acid residue or a plurality of such atoms and/or groups) in a binding cavity or region, which may bind to a compound such as a nucleic acid molecule, which is/are involved in binding.

By "fitting", is meant determining by automatic, or semi-automatic means, interactions between one or more atoms of a candidate molecule and at least one atom of a structure of the invention, and calculating the extent to which such interactions are stable. Interactions include attraction and repulsion, brought about by charge, steric considerations and the like. Various computer-based methods for fitting are described further By "root mean square (or rms) deviation", we mean the square root of the arithmetic mean of the squares of the deviations from the mean.

By a "computer system", is meant the hardware means, software means and data storage means used to analyze atomic coordinate data. The minimum hardware means of the computer-based systems of the present invention typically comprises a central processing unit (CPU), input means, output means and data storage means. Desirably a display or monitor is provided to visualize structure data. The data storage means may be RAM or means for accessing computer readable media of the invention. Examples of such systems are computer and tablet devices running Unix, Windows or Apple operating systems.

By "computer readable media", is meant any medium or media, which can be read and accessed directly or indirectly by a computer e.g., so that the media is suitable for use in the above-mentioned computer system. Such media include, but are not limited to: magnetic storage media such as floppy discs, hard disc storage medium and magnetic tape; optical storage media such as optical discs or CD-ROM; electrical storage media such as RAM and ROM; thumb drive devices; cloud storage devices and hybrids of these categories such as magnetic/optical storage media.

The invention comprehends the use of the protected guides described herein above in the optimized functional CRISPR-Cas enzyme systems described herein.

In some embodiments, the guide RNA is a toehold based guide RNA. The toehold based guide RNAs allows for guide RNAs only becoming activated based on the RNA levels of other transcripts in a cell. In certain embodiments, the guide RNA has an extension that includes a loop and a complementary sequence that fold over onto the guide and block the guide. The loop can be complementary to transcripts or miRNA in the cell and bind these transcripts if present. This will unfold the guide RNA allowing it to bind a Cas13 molecule. This bound complex can then knockdown transcripts or edit transcripts depending on the application.

Crispr-Cas Enzyme

In its unmodified form, a CRISPR-Cas protein is a catalytically inactive protein. This implies that upon formation of a nucleic acid-targeting complex (comprising a guide RNA hybridized to a target sequence wherein the RNA in or near (e.g., within 1, 2, 3, 4, 5, 6, 7, 8, 9, 10, 20, 50, or more base pairs from) the target sequence is modified (e.g. cleaved). As used herein the term "sequence(s) associated with a target RNA" refers to sequences near the vicinity of the target sequence (e.g. within 1, 2, 3, 4, 5, 6, 7, 8, 9, 10, 20, 50, or more base pairs from the target sequence, wherein the target sequence is comprised within a target RNA).

In some embodiments, a CRISPR-Cas protein is considered to substantially lack all DNA cleavage activity when the DNA cleavage activity of the mutated enzyme is about no more than 25%, 10%, 5%, 1%, 0.1%, 0.01%, or less of the RNA cleavage activity of the non-mutated form of the enzyme; an example can be when the RNA cleavage activity of the mutated form is nil or negligible as compared with the non-mutated form. In these embodiments, the CRISPR-Cas protein is used as a generic RNA binding protein. The mutations may be artificially introduced mutations or gain- or loss-of-function mutations.

In addition to the mutations described above, the CRISPR-Cas protein may be additionally modified. As used herein, the term "modified" with regard to a CRISPR-Cas protein generally refers to a CRISPR-Cas protein having one or more modifications or mutations (including point mutations, truncations, insertions, deletions, chimeras, fusion proteins, etc.) compared to the wild type Cas protein from which it is derived. By derived is meant that the derived enzyme is largely based, in the sense of having a high degree of sequence homology with, a wildtype enzyme, but that it has been mutated (modified) in some way as known in the art or as described herein.

The additional modifications of the CRISPR-Cas protein may or may not cause an altered functionality. By means of example, and in particular with reference to CRISPR-Cas protein, modifications which do not result in an altered functionality include for instance codon optimization for expression into a particular host, or providing the nuclease with a particular marker (e.g. for visualization). Modifications with may result in altered functionality may also include mutations, including point mutations, insertions, deletions, truncations (including split nucleases), etc. Fusion proteins may without limitation include for instance fusions with heterologous domains or functional domains (e.g. localization signals, catalytic domains, etc.). In certain embodiments, various different modifications may be combined (e.g. a mutated nuclease which is catalytically inactive and which further is fused to a functional domain, such as for instance to induce DNA methylation or another nucleic acid modification, such as including without limitation a break (e.g. by a different nuclease (domain)), a mutation, a deletion, an insertion, a replacement, a ligation, a digestion, a break or a recombination). As used herein, "altered functionality" includes without limitation an altered specificity (e.g. altered target recognition, increased (e.g. "enhanced" Cas proteins) or decreased specificity, or altered PAM recognition), altered activity (e.g. increased or decreased catalytic activity, including catalytically inactive nucleases or nickases), and/or altered stability (e.g. fusions with destalilization domains). Suitable heterologous domains include without limitation a nuclease, a ligase, a repair protein, a methyltransferase, (viral) integrase, a recombinase, a transposase, an argonaute, a cytidine deaminase, a retron, a group II intron, a phosphatase, a phosphorylase, a sulpfurylase, a kinase, a polymerase, an exonuclease, etc. Examples of all these modifications are known in the art. It will be understood that a "modified" nuclease as referred to herein, and in particular a "modified" Cas or "modified" CRISPR-Cas system or complex preferably still has the capacity to interact with or bind to the polynucleic acid (e.g. in complex with theguide molecule). Such modified Cas protein can be combined with the deaminase protein or active domain thereof as described herein.

In certain embodiments, CRISPR-Cas protein may comprise one or more modifications resulting in enhanced activity and/or specificity, such as including mutating residues that stabilize the targeted or non-targeted strand (e.g. eCas9; "Rationally engineered Cas9 nucleases with improved specificity", Slaymaker et al. (2016), Science, 351(6268): 84-88, incorporated herewith in its entirety by reference). In certain embodiments, the altered or modified activity of the engineered CRISPR protein comprises increased targeting efficiency or decreased off-target binding. In certain embodiments, the altered activity of the engineered CRISPR protein comprises modified cleavage activity. In certain embodiments, the altered activity comprises increased cleavage activity as to the target polynucleotide loci. In certain embodiments, the altered activity comprises decreased cleavage activity as to the target polynucleotide loci. In certain embodiments, the altered activity comprises decreased cleavage activity as to off-target polynucleotide loci. In certain embodiments, the altered or modified activity of the modified nuclease comprises altered helicase kinetics. In certain embodiments, the modified nuclease comprises a modification that alters association of the protein with the nucleic acid molecule comprising RNA (in the case of a Cas protein), or a strand of the target polynucleotide loci, or a strand of off-target polynucleotide loci. In an aspect of the invention, the engineered CRISPR protein comprises a modification that alters formation of the CRISPR complex. In certain embodiments, the altered activity comprises increased cleavage activity as to off-target polynucleotide loci. Accordingly, in certain embodiments, there is increased specificity for target polynucleotide loci as compared to off-target polynucleotide loci. In other embodiments, there is reduced specificity for target polynucleotide loci as compared to off-target polynucleotide loci. In certain embodiments, the mutations result in decreased off-target effects (e.g. cleavage or binding properties, activity, or kinetics), such as in case for Cas proteins for instance resulting in a lower tolerance for mismatches between target and guide RNA. Other mutations may lead to increased off-target effects (e.g. cleavage or binding properties, activity, or kinetics). Other mutations may lead to increased or decreased on-target effects (e.g. cleavage or binding properties, activity, or kinetics). In certain embodiments, the mutations result in altered (e.g. increased or decreased) helicase activity, association or formation of the functional nuclease complex (e.g. CRISPR-Cas complex). In certain embodiments, as described above, the mutations result in an altered PAM recognition, i.e. a different PAM may be (in addition or in the alternative) be recognized, compared to the unmodified Cas protein. Particularly preferred mutations include positively charged residues and/or (evolutionary) conserved residues, such as conserved positively charged residues, in order to enhance specificity. In certain embodiments, such residues may be mutated to uncharged residues, such as alanine.

Base Excision Repair Inhibitor

In some embodiments, the CD-functionalized CRISPR system further comprises a base excision repair (BER) inhibitor. Without wishing to be bound by any particular theory, cellular DNA-repair response to the presence of a U: G pairing in DNA may be responsible for a decrease in nucleobase editing efficiency in cells. Uracil DNA glycosylase catalyzes removal of uracil from DNA in cells, which may initiate base excision repair, such that the U: G pair is reversed to C: G. In some embodiments, the BER inhibitor is an uracyl glycosylase inhibitor or an active domain thereof.

In some embodiments, the BER inhibitor is an inhibitor of uracil DNA glycosylase (UDG). In some embodiments, the BER inhibitor is an inhibitor of human UDG. In some embodiments, the BER inhibitor is a polypeptide inhibitor. In some embodiments, the BER inhibitor is a protein that binds single-stranded DNA. For example, the BER inhibitor may be a *Erwinia* tasmaniensis single-stranded binding protein. In some embodiments, the BER inhibitor is a protein that binds uracil. In some embodiments, the BER inhibitor is a protein that binds uracil in DNA. In some embodiments, the BER inhibitor is a catalytically inactive UDG or binding domain thereof. In some embodiments, the BER inhibitor is a catalytically inactive UDG or binding domain thereof that does not excise uracil from the DNA. Other proteins that are capable of inhibiting (e.g., sterically blocking) UDG are within the scope of this disclosure. Additionally, any proteins that block or inhibit base-excision repair as also within the scope of this disclosure.

Without wishing to be bound by any particular theory, base excision repair may be inhibited by molecules that bind the edited strand, block the edited base, inhibit uracil DNA glycosylase, inhibit base excision repair, protect the edited base, and/or promote fixing of the non-targeted strand. Accordingly, the use of the BER inhibitor described herein can increase the editing efficiency of a cytidine deaminase that is capable of catalyzing a C to U change.

In particular embodiments, the uracil glycosylase inhibitor (UGI) is the uracil DNA glycosylase inhibitor of *Bacillus subtilis* bacteriophage PBS1 or an active fragment thereof, such as an 83 residue protein of *Bacillus subtilis* bacteriophage PBS1.

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. J. Biol. Chem. 264:1 163-1 171 (1989); Lundquist et al., Site-directed mutagenesis and characterization of uracil-DNA glycosylase inhibitor protein. Role of specific carboxylic amino acids in complex formation with *Escherichia coli* uracil-DNA glycosylase. J. Biol. Chem. 272:21408-21419 (1997); Ravishankar et al., X-ray analysis of a complex of *Escherichia coli* uracil DNA glycosylase (EcUDG) with a proteinaceous inhibitor. The structure elucidation of a prokaryotic UDG. Nucleic Acids Res. 26:4880-4887 (1998); and Putnam et al., Protein mimicry of DNA from crystal structures of the uracil-DNA glycosylase inhibitor protein and its complex with *Escherichia coli* uracil-DNA glycosylase. J. Mol. Biol. 287:331-346 (1999), the entire contents of each are incorporated herein by reference.

In some embodiments, the UGI comprises the following amino acid sequence:

>sp|P14739|UNGI_BPPB2 Uracil-DNA glycosylase inhibitor

MTNLSDIIEKETGKQLVIQESILMLPEEVEEVI-GNKPESDILVHTAYDESTDENVM LLTSDAP-EYKPWAL VIQDSNGENKIKML (SEQ ID NO: 48)

In some embodiments, the UGI domain comprises a wild-type UGI or a UGI as set forth in SEQ ID NO: 48. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 48. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 48. In some embodiments, a UGI comprises an amino acid sequence homologous to the amino acid sequence set forth in SEQ ID NO: 48 or an amino acid sequence homologous to a fragment of the amino acid sequence set forth in SEQ ID NO: 48. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 48. In some embodiments, the UGI variant comprises a fragment of UGI, such that the fragment is at least 70% identical, at least 80% identical, at least 90% identical, at least 95% identical, at least 96%) identical, at least 97% identical, at least 98% identical, at least 99% identical, at least 99.5%) identical, or at least 99.9% to the corresponding fragment of wild-type UGI or a UGI as set forth in SEQ ID NO: 48.

Accordingly, in the first design of the CD-functionalized CRISPR system discussed above, the CRISPR-Cas protein or the cytidine deaminase can be fused to or linked to a BER inhibitor (e.g., an inhibitor of uracyl DNA glycosylase). In some embodiments, the BER inhibitor can be comprised in one of the following structures (nCas13=catalytically inactive Cas13):

[CD]-[optional linker]-[nCas13]-[optional linker]-[BER inhibitor];

[CD]-[optional linker]-[BER inhibitor]-[optional linker]-[nCas13];

[BER inhibitor]-[optional linker]-[CD]-[optional linker]-[nCas13];

[BER inhibitor]-[optional linker]-[nCas13]-[optional linker]-[CD];

[nCas13]-[optional linker]-[CD]-[optional linker]-[BER inhibitor];

[nCas13]-[optional linker]-[BER inhibitor]-[optional linker]-[CD].

Similarly, in the second design of the CD-functionalized CRISPR system discussed above, the CRISPR-Cas protein, the cytidine deaminase, or the adaptor protein can be fused to or linked to a BER inhibitor (e.g., an inhibitor of uracil DNA glycosylase). In some embodiments, the BER inhibitor can be comprised in one of the following structures (nCas13=catalytically inactive Cas13):

[nCas13]-[optional linker]-[BER inhibitor];

[BER inhibitor]-[optional linker]-[nCas13];

[CD]-[optional linker]-[Adaptor]-[optional linker]-[BER inhibitor];

[CD]-[optional linker]-[BER inhibitor]-[optional linker]-[Adaptor];

[BER inhibitor]-[optional linker]-[CD]-[optional linker]-[Adaptor];

[BER inhibitor]-[optional linker]-[Adaptor]-[optional linker]-[CD];

[Adaptor]-[optional linker]-[CD]-[optional linker]-[BER inhibitor];

[Adaptor]-[optional linker]-[BER inhibitor]-[optional linker]-[CD].

In the third design of the CD-functionalized CRISPR system discussed above, the BER inhibitor can be inserted into an internal loop or unstructured region of a CRISPR-Cas protein.

Targeting to the Nucleus

In some embodiments, the methods of the present invention relate to modifying an Adenine in a target locus of interest, whereby the target locus is within a cell. In order to improve targeting of the CRISPR-Cas protein and/or the adenosine deaminase protein or catalytic domain thereof used in the methods of the present invention to the nucleus, it may be advantageous to provide one or both of these components with one or more nuclear localization sequences (NLSs).

In preferred embodiments, the NLSs used in the context of the present invention are heterologous to the proteins. Non-limiting examples of NLSs include an NLS sequence derived from: the NLS of the SV40 virus large T-antigen, having the amino acid sequence PKKKRKV (SEQ ID NO: 49) or PKKKRKVEAS (SEQ ID NO:50); the NLS from nucleoplasmin (e.g., the nucleoplasmin bipartite NLS with the sequence KRPAATKKAGQAKKKK (SEQ ID NO: 51)); the c-myc NLS having the amino acid sequence PAAKRVKLD (SEQ ID NO: 52) or RQRRNELKRSP (SEQ ID NO: 53); the hRNPA1 M9 NLS having the sequence NQSSNFGPMKGGNFGGRSSGPYGGGGQYFAK-PRNQGGY (SEQ ID NO: 54); the sequence RMRIZFKNKGKDTAELRRRRVEVSVELRKAKKD-EQILKRRNV (SEQ ID NO: 55) of the IBB domain from importin-alpha; the sequences VSRKRPRP (SEQ ID NO:56) and PPKKARED (SEQ ID NO: 57) of the myoma T protein; the sequence PQPKKKPL (SEQ ID NO: 58) of human p53; the sequence SALIKKKKKMAP (SEQ ID NO:59) of mouse c-abl IV; the sequences DRLRR (SEQ ID NO: 60) and PKQKKRK (SEQ ID NO: 61) of the influenza virus NS1; the sequence RKLKKKIKKL (SEQ ID NO: 62)

of the Hepatitis virus delta antigen; the sequence REKKKFLKRR (SEQ ID NO: 63) of the mouse Mx1 protein; the sequence KRKGDEVDGVDEVAKKKSKK (SEQ ID NO: 64) of the human poly(ADP-ribose) polymerase; and the sequence RKCLQAGMNLEARKTKK (SEQ ID NO: 65) of the steroid hormone receptors (human) glucocorticoid. In general, the one or more NLSs are of sufficient strength to drive accumulation of the DNA-targeting Cas protein in a detectable amount in the nucleus of a eukaryotic cell. In general, strength of nuclear localization activity may derive from the number of NLSs in the CRISPR-Cas protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for deaminase activity) at the target sequence, or assay for altered gene expression activity affected by DNA-targeting complex formation and/or DNA-targeting), as compared to a control not exposed to the CRISPR-Cas protein and deaminase protein, or exposed to a CRISPR-Cas and/or deaminase protein lacking the one or more NLSs.

The CRISPR-Cas and/or adenosine deaminase proteins may be provided with 1 or more, such as with, 2, 3, 4, 5, 6, 7, 8, 9, 10, or more heterologous NLSs. In some embodiments, the proteins comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. In preferred embodiments of the CRISPR-Cas proteins, an NLS attached to the C-terminal of the protein.

In certain embodiments of the methods provided herein, the CRISPR-Cas protein and the deaminase protein are delivered to the cell or expressed within the cell as separate proteins. In these embodiments, each of the CRISPR-Cas and deaminase protein can be provided with one or more NLSs as described herein. In certain embodiments, the CRISPR-Cas and deaminase proteins are delivered to the cell or expressed with the cell as a fusion protein. In these embodiments one or both of the CRISPR-Cas and deaminase protein is provided with one or more NLSs. Where the adenosine deaminase is fused to an adaptor protein (such as MS2) as described above, the one or more NLS can be provided on the adaptor protein, provided that this does not interfere with aptamer binding. In particular embodiments, the one or more NLS sequences may also function as linker sequences between the adenosine deaminase and the CRISPR-Cas protein.

In certain embodiments, guides of the invention comprise specific binding sites (e.g. aptamers) for adapter proteins, which may be linked to or fused to an adenosine deaminase or catalytic domain thereof. When such a guide forms a CRISPR complex (i.e. CRISPR-Cas protein binding to guide and target) the adapter proteins bind and, the adenosine deaminase or catalytic domain thereof associated with the adapter protein is positioned in a spatial orientation which is advantageous for the attributed function to be effective.

The skilled person will understand that modifications to the guide which allow for binding of the adapter+adenosine deaminase, but not proper positioning of the adapter+adenosine deaminase (e.g. due to steric hindrance within the three dimensional structure of the CRISPR complex) are modifications which are not intended. The one or more modified guide may be modified at the tetra loop, the stem loop 1, stem loop 2, or stem loop 3, as described herein, preferably at either the tetra loop or stem loop 2, and most preferably at both the tetra loop and stem loop 2.

Use of Orthogonal Catalytically Inactive CRISPR-Cas Proteins

In particular embodiments, the Cas13 nickase is used in combination with an orthogonal catalytically inactive CRISPR-Cas protein to increase efficiency of said Cas13 nickase (as described in Chen et al. 2017, Nature Communications 8:14958; doi: 10.1038/ncomms14958). More particularly, the orthogonal catalytically inactive CRISPR-Cas protein is characterized by a different PAM recognition site than the Cas13 nickase used in the AD-functionalized CRISPR system and the corresponding guide sequence is selected to bind to a target sequence proximal to that of the Cas13 nickase of the AD-functionalized CRISPR system. The orthogonal catalytically inactive CRISPR-Cas protein as used in the context of the present invention does not form part of the AD-functionalized CRISPR system but merely functions to increase the efficiency of said Cas13 nickase and is used in combination with a standard guide molecule as described in the art for said CRISPR-Cas protein. In particular embodiments, said orthogonal catalytically inactive CRISPR-Cas protein is a dead CRISPR-Cas protein, i.e. comprising one or more mutations which abolishes the nuclease activity of said CRISPR-Cas protein. In particular embodiments, the catalytically inactive orthogonal CRISPR-Cas protein is provided with two or more guide molecules which are capable of hybridizing to target sequences which are proximal to the target sequence of the Cas13 nickase. In particular embodiments, at least two guide molecules are used to target said catalytically inactive CRISPR-Cas protein, of which at least one guide molecule is capable of hybridizing to a target sequence 5" of the target sequence of the Cas13 nickase and at least one guide molecule is capable of hybridizing to a target sequence 3' of the target sequence of the Cas13 nickase of the AD-functionalized CRISPR system, whereby said one or more target sequences may be on the same or the opposite DNA strand as the target sequence of the Cas13 nickase. In particular embodiments, the guide sequences for the one or more guide molecules of the orthogonal catalytically inactive CRISPR-Cas protein are selected such that the target sequences are proximal to that of the guide molecule for the targeting of the AD-functionalized CRISPR, i.e. for the targeting of the Cas13 nickase. In particular embodiments, the one or more target sequences of the orthogonal catalytically inactive CRISPR-Cas enzyme are each separated from the target sequence of the Cas13 nickase by more than 5 but less than 450 basepairs. Optimal distances between the target sequences of the guides for use with the orthogonal catalytically inactive CRISPR-Cas protein and the target sequence of the AD-functionalized CRISPR system can be determined by the skilled person. In particular embodiments, the orthogonal CRISPR-Cas protein is a Class II, type II CRISPR protein. In particular embodiments, the orthogonal CRISPR-Cas protein is a Class II, type V CRISPR protein. In particular embodiments, the catalytically inactive orthogonal CRISPR-Cas protein In particular embodiments, the catalytically inactive orthogonal CRISPR-Cas protein has been modified to alter its PAM specificity as described elsewhere herein. In particular embodiments, the Cas13 protein nickase is a nickase which, by itself has limited activity in human cells, but which, in combination with an inactive orthogonal CRISPR-Cas protein and one or more corresponding proximal guides ensures the required nickase activity.

CRISPR Development and Use

The present invention may be further illustrated and extended based on aspects of CRISPR-Cas development and use as set forth in the following articles and particularly as relates to delivery of a CRISPR protein complex and uses of an RNA guided endonuclease in cells and organisms:

Multiplex genome engineering using CRISPR-Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121): 819-23 (2013);

RNA-guided editing of bacterial genomes using CRISPR-Cas systems. Jiang W., Bikard D., Cox D., Zhang F, Marraffini L A. Nat Biotechnol March; 31(3): 233-9 (2013);

One-Step Generation of Mice Carrying Mutations in Multiple Genes by CRISPR-Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, FA., Hsu, PD., Lin, CY., Gootenberg, J S., Konermann, S., Trevino, AE., Scott, DA., Inoue, A., Matoba, S., Zhang, Y., & Zhang, F. Cell August 28. pii: S0092-8674(13) 01015-5 (2013-A);

DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, TJ., Marraffini, LA., Bao, G., & Zhang, F. Nat Biotechnol doi: 10.1038/nbt.2647 (2013);

Genome engineering using the CRISPR-Cas9 system. Ran, FA., Hsu, PD., Wright, J., Agarwala, V., Scott, DA., Zhang, F. Nature Protocols November; 8(11): 2281-308 (2013-B);

Genome-Scale CRISPR-Cas9 Knockout Screening in Human Cells. Shalem, O., Sanjana, NE., Hartenian, E., Shi, X., Scott, DA., Mikkelson, T., Heckl, D., Ebert, BL., Root, DE., Doench, JG., Zhang, F. Science December 12. (2013);

Crystal structure of cas9 in complex with guide RNA and target DNA. Nishimasu, H., Ran, FA., Hsu, PD., Konermann, S., Shehata, SI., Dohmae, N., Ishitani, R., Zhang, F., Nureki, O. Cell February 27, 156(5): 935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014 (2014);

Development and Applications of CRISPR-Cas9 for Genome Engineering, Hsu P D, Lander E S, Zhang F., Cell. June 5; 157(6): 1262-78 (2014).

Genetic screens in human cells using the CRISPR-Cas9 system, Wang T, Wei J J, Sabatini D M, Lander E S., Science. January 3; 343(6166): 80-84. doi: 10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12): 1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1): 102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517(7536): 583-8 (2015).

A split-Cas9 architecture for inducible genome editing and transcription modulation, Zetsche B, Volz S E, Zhang F., (published online 2 Feb. 2015) Nat Biotechnol. February; 33(2): 139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260 Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520 (7546): 186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR-Cas9 cleavage of viral DNA efficiently suppresses hepatitis B virus," Scientific Reports 5:10833. doi: 10.1038/srep10833 (Jun. 2, 2015)

Nishimasu et al., Crystal Structure of *Staphylococcus aureus* Cas9," Cell 162, 1113-1126 (Aug. 27, 2015)

BCL11A enhancer dissection by Cas9-mediated in situ saturating mutagenesis, Canver et al., Nature 527 (7577): 192-7 (Nov. 12, 2015) doi: 10.1038/nature15521. Epub 2015 Sep. 16

Cpf1 Is a Single RNA-Guided Endonuclease of a Class 2 CRISPR-Cas System, Zetsche et al., Cell 163, 759-71 (Sep. 25, 2015).

Discovery and Functional Characterization of Diverse Class 2 CRISPR-Cas Systems, Shmakov et al., Molecular Cell, 60(3), 385-397 doi: 10.1016/j.molcel.2015.10.008 Epub Oct. 22, 2015.

Rationally engineered Cas9 nucleases with improved specificity, Slaymaker et al., Science 2016 Jan. 1 351 (6268): 84-88 doi: 10.1126/science.aad5227. Epub 2015 Dec. 1.

Gao et al, "Engineered Cpf1 Enzymes with Altered PAM Specificities," bioRxiv 091611; doi: http://dx.doi.org/10.1101/091611 (Dec. 4, 2016).

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293 FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and guide RNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR-Cas9 knockout and nucleotide preference at the cleavage site. The authors also found that the sequence preference for CRISPRi/a is substantially different from that for CRISPR-Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors we developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cpf1, a class 2 CRISPR nuclease from *Francisella novicida* U112 having features distinct from Cas9. Cpf1 is a single RNA-guided endonuclease lacking tracrRNA, utilizes a T-rich protospacer-adjacent motif, and cleaves DNA via a staggered DNA double-stranded break.

Shmakov et al. (2015) reported three distinct Class 2 CRISPR-Cas systems. Two system CRISPR enzymes (C2c1 and C2c3) contain RuvC-like endonuclease domains distantly related to Cpf1. Unlike Cpf1, C2c1 depends on both crRNA and tracrRNA for DNA cleavage. The third enzyme (C2c2) contains two predicted HEPN RNase domains and is tracrRNA independent.

Slaymaker et al (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

The methods and tools provided herein are exemplified for Cas13, a type II nuclease that does not make use of tracrRNA. Orthologs of Cas13 have been identified in different bacterial species as described herein. Further type II nucleases with similar properties can be identified using methods described in the art (Shmakov et al. 2015, 60:385-397; Abudayeh et al. 2016, Science, 5; 353(6299)). In particular embodiments, such methods for identifying novel CRISPR effector proteins may comprise the steps of selecting sequences from the database encoding a seed which identifies the presence of a CRISPR Cas locus, identifying loci located within 10 kb of the seed comprising Open Reading Frames (ORFs) in the selected sequences, selecting therefrom loci comprising ORFs of which only a single ORF encodes a novel CRISPR effector having greater than 700 amino acids and no more than 90% homology to a known CRISPR effector. In particular embodiments, the seed is a protein that is common to the CRISPR-Cas system, such as Cas1. In further embodiments, the CRISPR array is used as a seed to identify new effector proteins.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

With respect to general information on CRISPR/Cas Systems, components thereof, and delivery of such components, including methods, materials, delivery vehicles, vectors, particles, and making and using thereof, including as to amounts and formulations, as well as CRISPR-Cas-expressing eukaryotic cells, CRISPR-Cas expressing eukaryotes, such as a mouse, reference is made to: U.S. Pat. Nos. 8,999,641, 8,993,233, 8,697,359, 8,771,945, 8,795,965, 8,865,406, 8,871,445, 8,889,356, 8,889,418, 8,895,308, 8,906,616, 8,932,814, and 8,945,839; US Patent Publications U S 2014-0310830 (U.S. application Ser. No. 14/105, 031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256, 912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); US 2015-0184139 (U.S. application Ser. No. 14/324,960); Ser. No. 14/054,414 European Patent Applications EP 2 771 468 (EP13818570.7), EP 2 764 103 (EP13824232.6), and EP 2 784 162 (EP14170383.5); and PCT Patent Publications WO2014/093661 (PCT/US2013/074743), WO2014/093694 (PCT/US2013/074790), WO2014/093595 (PCT/US2013/074611), WO2014/093718 (PCT/US2013/074825), WO2014/093709 (PCT/US2013/074812), WO2014/093622 (PCT/US2013/074667), WO2014/093635 (PCT/US2013/074691), WO2014/093655 (PCT/US2013/074736), WO2014/093712 (PCT/US2013/074819), WO2014/093701 (PCT/US2013/074800), WO2014/018423 (PCT/US2013/051418), WO2014/204723 (PCT/US2014/041790), WO2014/204724 (PCT/US2014/041800), WO2014/204725 (PCT/US2014/041803), WO2014/204726 (PCT/US2014/041804), WO2014/204727 (PCT/US2014/041806), WO2014/204728 (PCT/US2014/041808), WO2014/204729 (PCT/US2014/041809), WO2015/089351 (PCT/US2014/069897), WO2015/089354 (PCT/US2014/069902), WO2015/089364 (PCT/US2014/069925), WO2015/089427 (PCT/US2014/070068), WO2015/089462 (PCT/US2014/070127), WO2015/089419 (PCT/US2014/070057), WO2015/089465 (PCT/US2014/070135), WO2015/089486 (PCT/US2014/070175), WO2015/058052 (PCT/US2014/061077), WO2015/070083 (PCT/US2014/064663), WO2015/089354 (PCT/US2014/069902), WO2015/089351 (PCT/US2014/069897), WO2015/089364 (PCT/US2014/069925), WO2015/089427 (PCT/US2014/070068), WO2015/089473 (PCT/US2014/070152), WO2015/089486 (PCT/US2014/070175), WO2016/049258 (PCT/US2015/051830), WO2016/094867 (PCT/US2015/065385), WO2016/094872 (PCT/US2015/065393), WO2016/094874 (PCT/US2015/065396), WO2016/106244 (PCT/US2015/067177).

Mention is also made of U.S. application 62/180,709, 17 Jun. 2015, PROTECTED GUIDE RNAS (PGRNAS); U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. applications 62/091,462, 12 Dec. 2014, 62/096,324, 23 Dec. 2014, 62/180,681, 17 Jun. 2015, and 62/237,496, 5 Oct. 2015, DEAD GUIDES FOR CRISPR TRANSCRIPTION FACTORS; U.S. application 62/091,456, 12 Dec. 2014 and 62/180,692, 17 Jun. 2015, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, 62/181,641, 18 Jun. 2015, and 62/181,667, 18 Jun. 2015, RNA-TARGETING SYSTEM; U.S. application 62/096,656, 24 Dec. 14 and 62/181,151, 17 Jun. 2015, CRISPR HAVING OR ASSOCIATED WITH DESTABILIZATION DOMAINS; U.S. application 62/096,697, 24 Dec. 2014, CRISPR HAVING OR ASSOCIATED WITH AAV; US application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; US application 61/939,154, 12 Feb. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. applications 62/054,675, 24 Sep. 2014 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014 and 62/181,690, 18 Jun. 2015, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19 Aug. 2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION. Mention is made of U.S. applications 62/181,663, 18 Jun. 2015 and 62/245,264, 22 Oct. 2015, NOVEL CRISPR ENZYMES AND SYSTEMS, U.S. applications 62/181,675, 18 Jun. 2015, 62/285,349, 22 Oct. 2015, 62/296,522, 17 Feb. 2016, and 62/320,231, 8 Apr. 2016, NOVEL CRISPR ENZYMES AND SYSTEMS, U.S. application 62/232,067, 24 Sep. 2015, U.S. application Ser. No. 14/975,085, 18 Dec. 2015, European application No. 16150428.7, U.S. application 62/205,733, 16 Aug. 2015, U.S. application 62/201,542, 5 Aug. 2015, U.S. application 62/193,507, 16 Jul. 2015, and U.S. application 62/181,739, 18 Jun. 2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15 Aug. 2015, U.S. application 62/180,699, 17 Jun. 2015, and U.S. application 62/038,358, 17 Aug. 2014, each entitled GENOME EDITING USING CAS9 NICKASES.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Type-VI CRISPR-Cas Protein

The application describes methods using Type-VI CRISPR-Cas proteins. This is exemplified herein with Cas13a, Cas13b, and Cas13c, whereby a number of orthologs or homologs have been identified. It will be apparent to the skilled person that further orthologs or homologs can be identified and that any of the functionalities described herein may be engineered into other orthologs, including chimeric enzymes comprising fragments from multiple orthologs.

Computational methods of identifying novel CRISPR-Cas loci are described in EP3009511 or US2016208243 and may comprise the following steps: detecting all contigs encoding the Cas1 protein; identifying all predicted protein coding genes within 20 kB of the cas1 gene; comparing the identified genes with Cas protein-specific profiles and predicting CRISPR arrays; selecting unclassified candidate CRISPR-Cas loci containing proteins larger than 500 amino acids (>500 aa); analyzing selected candidates using methods such as PSI-BLAST and HHPred to screen for known protein domains, thereby identifying novel Class 2 CRISPR-Cas loci (see also Schmakov et al. 2015, Mol Cell. 60(3):

385-97). In addition to the above mentioned steps, additional analysis of the candidates may be conducted by searching metagenomics databases for additional homologs. Additionally or alternatively, to expand the search to non-autonomous CRISPR-Cas systems, the same procedure can be performed with the CRISPR array used as the seed.

In one aspect the detecting all contigs encoding the Cas1 protein is performed by GenemarkS which a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, January 20; 8:18 (2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments.

Codon Optimized Nucleic Acid Sequences

Where the effector protein is to be administered as a nucleic acid, the application envisages the use of codon-optimized CRISPR-Cas type VI protein, and more particularly Cas13-encoding nucleic acid sequences (and optionally protein sequences). An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Cas13) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a RNA-targeting Cas protein is codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a RNA-targeting Cas protein corresponds to the most frequently used codon for a particular amino acid. As to codon usage in yeast, reference is made to the online Yeast Genome database available at www.yeastgenome.org/community/codon_usage.shtml, or *Codon selection in yeast*, Bennetzen and Hall, J Biol Chem. 1982 Mar. 25; 257(6): 3026-31. As to codon usage in plants including algae, reference is made to *Codon usage in higher plants, green algae, and cyanobacteria*, Campbell and Gowri, Plant Physiol. 1990 January; 92(1): 1-11; as well as *Codon usage in plant genes*, Murray et al, Nucleic Acids Res. 1989 Jan. 25; 17(2): 477-98; or *Selection on the codon bias of chloroplast and cyanelle genes in different plant and algal lineages*, Morton B R, J Mol Evol. 1998 April; 46(4): 449-59.

Orthologs of Cas13

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4): 359-66. doi: 10.1002/pro.2225). See also Shmakov et al. (2015) for application in the field of CRISPR-Cas loci. Homologous proteins may but need not be structurally related, or are only partially structurally related.

The Cas13 gene is found in several diverse bacterial genomes, typically in the same locus with cas1, cas2, and cas4 genes and a CRISPR cassette (for example, FNFX1_1431-FNFX1_1428 of *Francisella* cf. *novicida* Fx1). Thus, the layout of this putative novel CRISPR-Cas system appears to be similar to that of type II-B. Furthermore, similar to Cas9, the Cas13 protein contains a readily identifiable C-terminal region that is homologous to the transposon ORF-B and includes an active RuvC-like nuclease, an arginine-rich region, and a Zn finger (absent in Cas9). However, unlike Cas9, Cas13 is also present in several genomes without a CRISPR-Cas context and its relatively high similarity with ORF-B suggests that it might be a transposon component. It was suggested that if this was a genuine CRISPR-Cas system and Cas13 is a functional analog of Cas9 it would be a novel CRISPR-Cas type, namely type V (See Annotation and Classification of CRISPR-Cas Systems. Makarova K S, Koonin E V. Methods Mol Biol. 2015; 1311:47-75). However, as described herein, Cas13 is denoted to be in subtype V-A to distinguish it from C2c1p which does not have an identical domain structure and is hence denoted to be in subtype V-B.

The present invention encompasses the use of a Cas13 effector protein, derived from a Cas13 locus denoted as subtype V-A. Herein such effector proteins are also referred to as "Cas13p", e.g., a Cas13 protein (and such effector protein or Cas13 protein or protein derived from a Cas13 locus is also called "CRISPR-Cas protein").

In particular embodiments, the effector protein is a Cas13 effector protein from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Carnobacterium, Corynebacter, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Leptospira, Desulfovibrio, Desulfonatronum, Opitutaceae, Tuberibacillus, Bacillus, Brevibacilus, Methylobacterium, Butyvibrio, Perigrinibacterium, Pareubacterium, Moraxella, Thiomicrospira* or *Acidaminococcus*. In particular embodiments, the Cas13 effector protein is selected from an organism from a genus selected from *Eubacterium, Lachnospiraceae, Leptotrichia, Francisella, Methanomethyophilus, Porphyromonas, Prevotella, Leptospira, Butyvibrio, Perigrinibacterium, Pareubacterium, Moraxella, Thiomicrospira* or *Acidaminococcus*.

In further particular embodiments, the Cas13 effector protein is from an organism selected from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii, L inadai, F. tularensis* 1, *P. albensis, L. bacterium, B. proteoclasticus, P. bacterium, P. crevioricanis, P. disiens* and *P. macacae.*

The effector protein may comprise a chimeric effector protein comprising a first fragment from a first effector protein (e.g., a Cas13) ortholog and a second fragment from a second effector (e.g., a Cas13) protein ortholog, and wherein the first and second effector protein orthologs are different. At least one of the first and second effector protein (e.g., a Cas13) orthologs may comprise an effector protein (e.g., a Cas13) from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium, Butyvibrio, Perigrinibacterium, Pareubacterium, Moraxella, Thiomicrospira* or *Acidaminococcus*; e.g., a chimeric effector protein comprising a first fragment and a second fragment wherein each of the first and second fragments is selected from a Cas13 of an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium, Butyvibrio, Perigrinibacterium, Pareubacterium, Moraxella, Thiomicrospira* or *Acidaminococcus* wherein the first and second fragments are not from the same bacteria; for instance a chimeric effector protein comprising a first fragment and a second fragment wherein each of the first and second fragments is selected from a Cas13 of *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocyto-*

*genes, L. ivanovii; C. botulinum, C. difficile, C. tetani, C. sordellii; Francisella tularensis* 1, *Prevotella albensis, Lachnospiraceae bacterium* MC2017 1, *Butyrivibrio proteoclasticus, Peregrinibacteria bacterium* GW2011 GWA2_33_10, *Parcubacteria bacterium* GW2011 GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*, wherein the first and second fragments are not from the same bacteria.

In a more preferred embodiment, the Cas13p is derived from a bacterial species selected from *Francisella tularensis* 1, *Prevotella albensis, Lachnospiraceae bacterium* MC2017 1, *Butyrivibrio proteoclasticus, Peregrinibacteria bacterium* GW2011 GWA2_33_10, *Parcubacteria bacterium* GW2011 GWC2_44 17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Moraxella bovoculi* AAX08_00205, *Moraxella bovoculi* AAX11_00205, *Butyrivibrio* sp. NC3005, *Thiomicrospira* sp. XS5, *Leptospira inadai, Lachnospiraceae bacterium* ND2006, *Porphyromonas crevioricanis* 3, *Prevotella disiens* and *Porphyromonas macacae*. In certain embodiments, the Cas13p is derived from a bacterial species selected from *Acidaminococcus* sp. BV3L6, *Lachnospiraceae bacterium* MA2020. In certain embodiments, the effector protein is derived from a subspecies of *Francisella tularensis* 1, including but not limited to *Francisella tularensis* subsp. *Novicida*. In certain preferred embodiments, the Cas13p is derived from a bacterial species selected from *Acidaminococcus* sp. BV3L6, *Lachnospiraceae bacterium* ND2006, *Lachnospiraceae bacterium* MA2020, *Moraxella bovoculi* AAX08_00205, *Moraxella bovoculi* AAX11_00205, *Butyrivibrio* sp. NC3005, or *Thiomicrospira* sp. XS5.

In particular embodiments, the homologue or orthologue of Cas13 as referred to herein has a sequence homology or identity of at least 80%, more preferably at least 85%, even more preferably at least 90%, such as for instance at least 95% with the example Cas13 proteins disclosed herein. In further embodiments, the homologue or orthologue of Cas13 as referred to herein has a sequence identity of at least 80%, more preferably at least 85%, even more preferably at least 90%, such as for instance at least 95% with the wild type Cas13. Where the Cas13 has one or more mutations (mutated), the homologue or orthologue of said Cas13 as referred to herein has a sequence identity of at least 80%, more preferably at least 85%, even more preferably at least 90%, such as for instance at least 95% with the mutated Cas13.

In an embodiment, the Cas13 protein may be an ortholog of an organism of a genus which includes, but is not limited to, *Acidaminococcus* sp, *Lachnospiraceae bacterium* or *Moraxella bovoculi*; in particular embodiments, the type V Cas protein may be an ortholog of an organism of a species which includes, but is not limited to *Acidaminococcus* sp. BV3L6; *Lachnospiraceae bacterium* ND2006 (LbCas13) or *Moraxella bovoculi* 237. In particular embodiments, the homologue or orthologue of Cas13 as referred to herein has a sequence homology or identity of at least 80%, more preferably at least 85%, even more preferably at least 90%, such as for instance at least 95% with one or more of the Cas13 sequences disclosed herein. In further embodiments, the homologue or orthologue of Cas13 as referred to herein has a sequence identity of at least 80%, more preferably at least 85%, even more preferably at least 90%, such as for instance at least 95% with the wild type FnCas13, AsCas13 or LbCas13.

In particular embodiments, the Cas13 protein of the invention has a sequence homology or identity of at least 60%, more particularly at least 70, such as at least 80%, more preferably at least 85%, even more preferably at least 90%, such as for instance at least 95% with FnCas13, AsCas13 or LbCas13. In further embodiments, the Cas13 protein as referred to herein has a sequence identity of at least 60%, such as at least 70%, more particularly at least 80%, more preferably at least 85%, even more preferably at least 90%, such as for instance at least 95% with the wild type AsCas13 or LbCas13. In particular embodiments, the Cas13 protein of the present invention has less than 60% sequence identity with FnCas13. The skilled person will understand that this includes truncated forms of the Cas13 protein whereby the sequence identity is determined over the length of the truncated form. In particular embodiments, the Cas13 enzyme is not FnCas13.

Modified Cas13 Enzymes

In particular embodiments, it is of interest to make use of an engineered Cas13 protein as defined herein, such as Cas13, wherein the protein complexes with a nucleic acid molecule comprising RNA to form a CRISPR complex, wherein when in the CRISPR complex, the nucleic acid molecule targets one or more target polynucleotide loci, the protein comprises at least one modification compared to unmodified Cas13 protein, and wherein the CRISPR complex comprising the modified protein has altered activity as compared to the complex comprising the unmodified Cas13 protein. It is to be understood that when referring herein to CRISPR "protein", the Cas 13 protein preferably is a modified CRISPR-Cas protein (e.g. having increased or decreased (or no) enzymatic activity, such as without limitation including Cas13. The term "CRISPR protein" may be used interchangeably with "CRISPR-Cas protein", irrespective of whether the CRISPR protein has altered, such as increased or decreased (or no) enzymatic activity, compared to the wild type CRISPR protein.

Computational analysis of the primary structure of Cas13 nucleases reveals three distinct regions. First a C-terminal RuvC like domain, which is the only functional characterized domain. Second a N-terminal alpha-helical region and thirst a mixed alpha and beta region, located between the RuvC like domain and the alpha-helical region.

Several small stretches of unstructured regions are predicted within the Cas13 primary structure. Unstructured regions, which are exposed to the solvent and not conserved within different Cas13 orthologs, are preferred sides for splits and insertions of small protein sequences. In addition, these sides can be used to generate chimeric proteins between Cas13 orthologs.

Based on the above information, mutants can be generated which lead to inactivation of the enzyme or which modify the double strand nuclease to nickase activity. In alternative embodiments, this information is used to develop enzymes with reduced off-target effects (described elsewhere herein)

In certain of the above-described Cas13 enzymes, the enzyme is modified by mutation of one or more residues (in the RuvC domain) including but not limited to positions R909, R912, R930, R947, K949, R951, R955, K965, K968, K1000, K1002, R1003, K1009, K1017, K1022, K1029, K1035, K1054, K1072, K1086, R1094, K1095, K1109, K1118, K1142, K1150, K1158, K1159, R1220, R1226, R1242, and/or R1252 with reference to amino acid position numbering of AsCas13 (*Acidaminococcus* sp. BV3L6). In certain embodiments, the Cas13 enzymes comprising said one or more mutations have modified, more preferably increased specificity for the target.

In certain of the above-described non-naturally-occurring CRISPR-Cas proteins, the enzyme is modified by mutation of one or more residues (in the RAD50) domain including but not limited positions K324, K335, K337, R331, K369, K370, R386, R392, R393, K400, K404, K406, K408, K414, K429, K436, K438, K459, K460, K464, R670, K675, R681, K686, K689, R699, K705, R725, K729, K739, K748, and/or K752 with reference to amino acid position numbering of AsCas13 (*Acidaminococcus* sp. BV3L6). In certain embodiments, the Cas13 enzymes comprising said one or more mutations have modified, more preferably increased specificity for the target.

In certain of the Cas13 enzymes, the enzyme is modified by mutation of one or more residues including but not limited positions R912, T923, R947, K949, R951, R955, K965, K968, K1000, R1003, K1009, K1017, K1022, K1029, K1072, K1086, F1103, R1226, and/or R1252 with reference to amino acid position numbering of AsCas13 (*Acidaminococcus* sp. BV3L6). In certain embodiments, the Cas13 enzymes comprising said one or more mutations have modified, more preferably increased specificity for the target.

In certain embodiments, the Cas13 enzyme is modified by mutation of one or more residues including but not limited positions R833, R836, K847, K879, K881, R883, R887, K897, K900, K932, R935, K940, K948, K953, K960, K984, K1003, K1017, R1033, R1138, R1165, and/or R1252 with reference to amino acid position numbering of LbCas13 (*Lachnospiraceae bacterium* ND2006). In certain embodiments, the Cas13 enzymes comprising said one or more mutations have modified, more preferably increased specificity for the target.

In certain embodiments, the Cas13 enzyme is modified by mutation of one or more residues including but not limited positions K15, R18, K26, Q34, R43, K48, K51, R56, R84, K85, K87, N93, R103, N104, T118, K123, K134, R176, K177, R192, K200, K226, K273, K275, T291, R301, K307, K369, S404, V409, K414, K436, K438, K468, D482, K516, R518, K524, K530, K532, K548, K559, K570, R574, K592, D596, K603, K607, K613, C647, R681, K686, H720, K739, K748, K757, T766, K780, R790, P791, K796, K809, K815, T816, K860, R862, R863, K868, K897, R909, R912, T923, R947, K949, R951, R955, K965, K968, K1000, R1003, K1009, K1017, K1022, K1029, A1053, K1072, K1086, F1103, S1209, R1226, R1252, K1273, K1282, and/or K1288 with reference to amino acid position numbering of AsCas13 (*Acidaminococcus* sp. BV3L6). In certain embodiments, the Cas13 enzymes comprising said one or more mutations have modified, more preferably increased specificity for the target.

In certain embodiments, the enzyme is modified by mutation of one or more residues including but not limited positions K15, R18, K26, R34, R43, K48, K51, K56, K87, K88, D90, K96, K106, K107, K120, Q125, K143, R186, K187, R202, K210, K235, K296, K298, K314, K320, K326, K397, K444, K449, E454, A483, E491, K527, K541, K581, R583, K589, K595, K597, K613, K624, K635, K639, K656, K660, K667, K671, K677, K719, K725, K730, K763, K782, K791, R800, K809, K823, R833, K834, K839, K852, K858, K859, K869, K871, R872, K877, K905, R918, R921, K932, 1960, K962, R964, R968, K978, K981, K1013, R1016, K1021, K1029, K1034, K1041, K1065, K1084, and/or K1098 with reference to amino acid position numbering of FnCas13 (*Francisella novicida* U112). In certain embodiments, the Cas13 enzymes comprising said one or more mutations have modified, more preferably increased specificity for the target.

In certain embodiments, the enzyme is modified by mutation of one or more residues including but not limited positions K15, R18, K26, K34, R43, K48, K51, R56, K83, K84, R86, K92, R102, K103, K116, K121, R158, E159, R174, R182, K206, K251, K253, K269, K271, K278, P342, K380, R385, K390, K415, K421, K457, K471, A506, R508, K514, K520, K522, K538, Y548, K560, K564, K580, K584, K591, K595, K601, K634, K640, R645, K679, K689, K707, T716, K725, R737, R747, R748, K753, K768, K774, K775, K785, K787, R788, Q793, K821, R833, R836, K847, K879, K881, R883, R887, K897, K900, K932, R935, K940, K948, K953, K960, K984, K1003, K1017, R1033, K1121, R1138, R1165, K1190, K1199, and/or K1208 with reference to amino acid position numbering of LbCas13 (*Lachnospiraceae bacterium* ND2006). In certain embodiments, the Cas13 enzymes comprising said one or more mutations have modified, more preferably increased specificity for the target.

In certain embodiments, the enzyme is modified by mutation of one or more residues including but not limited positions K14, R17, R25, K33, M42, Q47, K50, D55, K85, N86, K88, K94, R104, K105, K118, K123, K131, R174, K175, R190, R198, 1221, K267, Q269, K285, K291, K297, K357, K403, K409, K414, K448, K460, K501, K515, K550, R552, K558, K564, K566, K582, K593, K604, K608, K623, K627, K633, K637, E643, K780, Y787, K792, K830, Q846, K858, K867, K876, K890, R900, K901, M906, K921, K927, K928, K937, K939, R940, K945, Q975, R987, R990, K1001, R1034, I1036, R1038, R1042, K1052, K1055, K1087, R1090, K1095, N1103, K1108, K1115, K1139, K1158, R1172, K1188, K1276, R1293, A1319, K1340, K1349, and/or K1356 with reference to amino acid position numbering of MbCas13 (*Moraxella bovoculi* 237). In certain embodiments, the Cas13 enzymes comprising said one or more mutations have modified, more preferably increased specificity for the target.

In one embodiment, the Cas13 protein is modified with a mutation at S1228 (e.g., S1228A) with reference to amino acid position numbering of AsCas13. See Yamano et al., Cell 165:949-962 (2016), which is incorporated herein by reference in its entirety.

In certain embodiments, the Cas13 protein has been modified to recognize a non-natural PAM, such as recognizing a PAM having a sequence or comprising a sequence YCN, YCV, AYV, TYV, RYN, RCN, TGYV, NTTN, TTN, TRTN, TYTV, TYCT, TYCN, TRTN, NTTN, TACT, TYCC, TRTC, TATV, NTTV, TTV, TSTG, TVTS, TYYS, TCYS, TBYS, TCYS, TNYS, TYYS, TNTN, TSTG, TTCC, TCCC, TATC, TGTG, TCTG, TYCV, or TCTC. In particular embodiments, said mutated Cas13 comprises one or more mutated amino acid residue at position 11, 12, 13, 14, 15, 16, 17, 34, 36, 39, 40, 43, 46, 47, 50, 54, 57, 58, 111, 126, 127, 128, 129, 130, 131, 132, 133, 134, 135, 136, 157, 158, 159, 160, 161, 162, 163, 164, 165, 166, 167, 168, 169, 170, 171, 172, 173, 174, 175, 176, 177, 178, 532, 533, 534, 535, 536, 537, 538, 539, 540, 541, 542, 543, 544, 545, 546, 547, 548, 549, 550, 551, 552, 553, 554, 555, 556, 565, 566, 567, 568, 569, 570, 571, 572, 573, 574, 575, 592, 593, 594, 595, 596, 597, 598, 599, 600, 601, 602, 603, 604, 605, 606, 607, 608, 609, 610, 611, 612, 613, 614, 615, 616, 617, 618, 619, 620, 626, 627, 628, 629, 630, 631, 632, 633, 634, 635, 636, 637, 638, 642, 643, 644, 645, 646, 647, 648, 649, 651, 652, 653, 654, 655, 656, 676, 679, 680, 682, 683, 684, 685, 686, 687, 688, 689, 690, 691, 692, 693, 707, 711, 714, 715, 716, 717, 718, 719, 720, 721, 722, 739, 765, 768, 769, 773, 777, 778, 779, 780, 781, 782, 783, 784, 785, 786, 871, 872, 873, 874, 875, 876, 877, 878, 879, 880, 881, 882, 883, 884, or 1048 of AsCas13 or a position corresponding thereto in a Cas13 ortholog; preferably, one or more mutated amino acid residue at position 130, 131, 132, 133, 134, 135, 136, 162, 163, 164, 165, 166, 167, 168, 169, 170, 171, 172, 173, 174, 175, 176, 177, 536, 537, 538, 539, 540, 541, 542, 543, 544, 545, 546, 547, 548, 549, 550, 551, 552, 570, 571, 572, 573, 595, 596, 597, 598, 599, 600, 601, 602, 603, 604, 605, 606, 607, 608, 609, 610, 611, 612, 613, 614, 615, 630, 631, 632, 646, 647, 648, 649, 650, 651, 652, 653, 683, 684, 685, 686, 687, 688, 689, or 690.

In certain embodiments, the Cas13 protein is modified to have increased activity, i.e. wider PAM specificity. In particular embodiments, the Cas13 protein is modified by mutation of one or more residues including but not limited positions 539, 542, 547, 548, 550, 551, 552, 167, 604, and/or 607 of AsCas13, or the corresponding position of an AsCas 13 orthologue, homologue, or variant, preferably mutated amino acid residues at positions 542 or 542 and 607, wherein said mutations preferably are 542R and 607R, such as S542R and K607R; or preferably mutated amino acid residues at positions 542 and 548 (and optionally 552), wherein said mutations preferably are 542R and 548V (and optionally 552R), such as S542R and K548V (and optionally N552R); or at position 532, 538, 542, and/or 595 of LbCas13, or the corresponding position of an AsCas13 orthologue, homologue, or variant, preferably mutated amino acid residues at positions 532 or 532 and 595, wherein said mutations preferably are 532R and 595R, such as G532R and K595R; or preferably mutated amino acid residues at positions 532 and 538 (and optionally 542), wherein said mutations preferably are 532R and 538V (and optionally 542R), such as G532R and K538V (and optionally Y542R), most preferably wherein said mutations are S542R and K607R, S542R and K548V, or S542R, K548V and N552R of AsCas13.

Deactivated/Inactivated Cas13 Protein

Where the Cas13 protein has nuclease activity, the Cas13 protein may be modified to have diminished nuclease activity e.g., nuclease inactivation of at least 70%, at least 80%, at least 90%, at least 95%, at least 97%, or 100% as compared with the wild type enzyme; or to put in another way, a Cas13 enzyme having advantageously about 0% of the nuclease activity of the non-mutated or wild type Cas13 enzyme or CRISPR-Cas protein, or no more than about 3% or about 5% or about 10% of the nuclease activity of the non-mutated or wild type Cas13 enzyme, e.g. of the non-mutated or wild type *Francisella novicida* U112 (FnCas13), *Acidaminococcus* sp. BV3L6 (AsCas13), *Lachnospiraceae bacterium* ND2006 (LbCas13) or *Moraxella bovoculi* 237 (MbCas13 Cas13 enzyme or CRISPR-Cas protein. This is possible by introducing mutations into the nuclease domains of the Cas13 and orthologs thereof.

In preferred embodiments of the present invention at least one Cas13 protein is used which is a Cas13 nickase. More particularly, a Cas13 nickase is used which does not cleave the target strand but is capable of cleaving only the strand which is complementary to the target strand, i.e. the non-target DNA strand also referred to herein as the strand which is not complementary to the guide sequence. More particularly the Cas13 nickase is a Cas13 protein which comprises a mutation in the arginine at position 1226A in the Nuc domain of Cas13 from *Acidaminococcus* sp., or a corresponding position in a Cas13 ortholog. In further particular embodiments, the enzyme comprises an arginine-to-alanine substitution or an R1226A mutation. It will be understood by the skilled person that where the enzyme is not AsCas13, a mutation may be made at a residue in a corresponding position. In particular embodiments, the Cas13 is FnCas13 and the mutation is at the arginine at position R1218. In particular embodiments, the Cas13 is LbCas13 and the mutation is at the arginine at position R1138. In particular embodiments, the Cas13 is MbCas13 and the mutation is at the arginine at position R1293.

In certain embodiments, use is made additionally or alternatively of a CRISPR-Cas protein which is engineered and can comprise one or more mutations that reduce or eliminate a nuclease activity. The amino acid positions in the FnCas13p RuvC domain include but are not limited to D917A, E1006A, E1028A, D1227A, D1255A, N1257A, D917A, E1006A, E1028A, D1227A, D1255A and N1257A. Applicants have also identified a putative second nuclease domain which is most similar to PD-(D/E) XK nuclease superfamily and HincII endonuclease like. The point mutations to be generated in this putative nuclease domain to substantially reduce nuclease activity include but are not limited to N580A, N584A, T587A, W609A, D610A, K613A, E614A, D616A, K624A, D625A, K627A and Y629A. In a preferred embodiment, the mutation in the FnCas13p RuvC domain is D917A or E1006A, wherein the D917A or E1006A mutation completely inactivates the DNA cleavage activity of the FnCas13 effector protein. In another embodiment, the mutation in the FnCas13p RuvC domain is D1255A, wherein the mutated FnCas13 effector protein has significantly reduced nucleolytic activity.

More particularly, the inactivated Cas13 enzymes include enzymes mutated in amino acid positions As908, As993, As1263 of AsCas13 or corresponding positions in Cas13 orthologs. Additionally, the inactivated Cas13 enzymes include enzymes mutated in amino acid position Lb832, 925, 947 or 1180 of LbCas13 or corresponding positions in Cas13 orthologs. More particularly, the inactivated Cas13 enzymes include enzymes comprising one or more of mutations AsD908A, AsE993A, AsD1263A of AsCas13 or corresponding mutations in Cas13 orthologs. Additionally, the inactivated Cas13 enzymes include enzymes comprising one or more of mutations LbD832A, E925A, D947A or D1180A of LbCas13 or corresponding mutations in Cas13 orthologs.

Mutations can also be made at neighboring residues, e.g., at amino acids near those indicated above that participate in the nuclease activity. In some embodiments, only the RuvC domain is inactivated, and in other embodiments, another putative nuclease domain is inactivated, wherein the effector protein complex functions as a nickase and cleaves only one DNA strand. In a preferred embodiment, the other putative nuclease domain is a HincII-like endonuclease domain.

The inactivated Cas13 or Cas13 nickase may have associated (e.g., via fusion protein) one or more functional domains, including for example, an adenosine deaminase or catalytic domain thereof. In some cases it is advantageous that additionally at least one heterologous NLS is provided. In some instances, it is advantageous to position the NLS at the N terminus. In general, the positioning of the one or more functional domain on the inactivated Cas13 or Cas13 nickase is one which allows for correct spatial orientation for the functional domain to affect the target with the attributed functional effect. For example, when the functional domain is an adenosine deaminase catalytic domain thereof, the adenosine deaminase catalytic domain is placed in a spatial orientation which allows it to contact and deaminate a target adenine. This may include positions other than the N-/C-terminus of Cas13. In some embodiments, the adenosine deaminase protein or catalytic domain thereof is inserted into an internal loop of Cas13.

Determination of PAM

Determination of PAM can be ensured as follows. This experiment closely parallels similar work in *E. coli* for the heterologous expression of StCas9 (Sapranauskas, R. et al. Nucleic Acids Res 39, 9275-9282 (2011)). Applicants introduce a plasmid containing both a PAM and a resistance gene into the heterologous *E. coli*, and then plate on the corresponding antibiotic. If there is DNA cleavage of the plasmid, Applicants observe no viable colonies.

In further detail, the assay is as follows for a DNA target. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has an 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid DNA was isolated. Plasmid DNA was used as template for PCR amplification and subsequent deep sequencing. Representation of all PAMs in the untransfomed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

The following PAMs have been identified for certain wild-type Cas13 orthologues: the *Acidaminococcus* sp. BV3L6 Cas13 (AsCas13), *Lachnospiraceae bacterium* ND2006 Cas13 (LbCas13) and *Prevotella albensis* (PaCas13) can cleave target sites preceded by a TTTV PAM, where Vis A/C or G, FnCas13p, can cleave sites preceded by TTN, where N is A/C/G or T. The *Moraxella bovoculi* AAX08_00205, *Moraxella bovoculi* AAX11_00205, *Butyrivibrio* sp. NC3005, *Thiomicrospira* sp. XS5, or *Lachnospiraceae bacterium* MA2020 PAM is 5' TTN, where N is A/C/G or T. The natural PAM sequence is TTTV or BTTV, wherein B is T/C or G and Vis A/C or G and the effector protein is *Moraxella lacunata* Cas13.

Codon Optimized Nucleic Acid Sequences

Where the effector protein is to be administered as a nucleic acid, the application envisages the use of codon-optimized CRISPR-Cas type V protein, and more particularly Cas13-encoding nucleic acid sequences (and optionally protein sequences). An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Cas13) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at www.yeastgenome.org/community/codon_usage.shtml, or *Codon selection in yeast*, Bennetzen and Hall, J Biol Chem. 1982 Mar. 25; 257(6): 3026-31. As to codon usage in plants including algae, reference is made to *Codon usage in higher plants, green algae, and cyanobacteria*, Campbell and Gowri, Plant Physiol. 1990 January; 92(1): 1-11; as well as *Codon usage in plant genes*, Murray et al, Nucleic Acids Res. 1989 Jan. 25; 17(2): 477-98; or *Selection on the codon bias of chloroplast and cyanelle genes in different plant and algal lineages*, Morton B R, J Mol Evol. 1998 April; 46(4): 449-59.

In certain example embodiments, the CRISPR Cas protein is selected from Table 1.

TABLE 1

| C2c2 orthologue | Code | Multi Letter |
|---|---|---|
| *Leptotrichia shahii* | C2-2 | Lsh |
| *L wadei* F0279 (Lw2) | C2-3 | Lw2 |
| *Listeria seeligeri* | C2-4 | Lse |
| *Lachnospiraceae bacterium* MA2020 | C2-5 | LbM |
| *Lachnospiraceae bacterium* NK4A179 | C2-6 | LbNK179 |
| [*Clostridium*] *aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| *Listeriaceae bacterium* FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |

In certain example embodiments, the CRISPR effector protein is a Cas13a protein selected from Table 2

TABLE 2

| | | | |
|---|---|---|---|
| c2c2-5 | 1 | Lachnospiraceae bacterium MA2020 (SEQ ID NO: 67) | MQISKVNHKHVAVGQKDRERITGFIYNDPVGDEKSLEDVVA<br>KRANDTKVLFNVFNTKDLYDSQESDKSEKDKEIISKGAKFV<br>AKSFNSAITILKKQNKIYSTLTSQQVIKELKDKFGGARIYDDD<br>IEEALTETLKKSFRKENVRNSIKVLIENAAGIRSSLSKDEEELI<br>QEYFVKQLVEEYTKTKLQKNVVKSIKNQNMVIQPDSDSQVL<br>SLSESRREKQSSAVSSDTLVNCKEKDVLKAFLTDYAVLDEDE<br>RNSLLWKLRNLVNLYFYGSESIRDYSYTKEKSVWKEHDEQK<br>ANKTLFIDEICHITKIGKNGKEQKVLDYEENRSRCRKQNINY<br>YRSALNYAKNNTSGIFENEDSNHFWIHLIENEVERLYNGIEN<br>GEEFKFETGYISEKVWKAVINHLSIKYIALGKAVYNYAMKEL<br>SSPGDIEPGKIDDSYINGITSFDYEIIKAEESLQRDISMNVVFAT<br>NYLACATVDTDKDFLLFSKEDIRSCTKKDGNLCKNIMQFWG<br>GYSTWKNFCEEYLKDDKDALELLYSLKSMLYSMRNSSFHFS<br>TENVDNGSWDTELIGKLFEEDCNRAARIEKEKFYNNNLHMF<br>YSSSLLEKVLERLYSSHHERASQVPSFNRVFVRKNFPSSLSEQ<br>RITPKFTDSKDEQIWQSAVYYLCKEIYYNDFLQSKEAYKLFR<br>EGVKNLDKNDINNQKAADSFKQAVVYYGKAIGNATLSQVC<br>QAIMTEYNRQNNDGLKKKSAYAEKQNSNKYKHYPLFLKQV<br>LQSAFWEYLDENKEIYGFISAQIHKSNVEIKAEDFIANYSSQQ<br>YKKLVDKVKKTPELQKWYTLGRLINPRQANQFLGSIRNYVQ<br>FVKDIQRRAKENGNPIRNYYEVLESDSIIKILEMCTKLNGTTS<br>NDIHDYFRDEDEYAEYISQFVNFGDVHSGAALNAFCNSESEG<br>KKNGIYYDGINPIVNRNWVLCKLYGSPDLISKIISRVNENMIH<br>DFHKQEDLIREYQIKGICSNKKEQQDLRTFQVLKNRVELRDI<br>VEYSEIINELYGQLIKWCYLRERDLMYFQLGFHYLCLNNASS<br>KEADYIKINVDDRNISGAILYQIAAMYINGLPVYYKKDDMY<br>VALKSGKKASDELNSNEQTSKKINYFLKYGNNILGDKKDQL<br>YLAGLELFENVAEHENIIIFRNEIDHFHYFYDRDRSMLDLYSE<br>VFDRFFTYDMKLRKNVVNMLYNILLDHNIVSSFVFETGEKK<br>VGRGDSEVIKPSAKIRLRANNGVSSDVFTYKVGSKDELKIAT<br>LPAKNEEFLLNVARLIYYPDMEAVSENMVREGVVKVEKSND<br>KKGKISRGSNTRSSNQSKYNNKSKNRMNYSMGSIFEKMDLK<br>FD |
| c2c2-6 | 2 | Lachnospiraceae bacterium NK4A179 (SEQ ID NO: 68) | MKISKVREENRGAKLTVNAKTAVVSENRSQEGILYNDPSRY<br>GKSRKNDEDRDRYIESRLKSSGKLYRIFNEDKNKRETDELQ<br>WFLSEIVKKINRRNGLVLSDMLSVDDRAFEKAFEKYAELSYT<br>NRRNKVSGSPAFETCGVDAATAERLKGIISETNFINRIKNNID<br>NKVSEDIIDRIIAKYLKKSLCRERVKRGLKKLLMNAFDLPYS<br>DPDIDVQRDFIDYVLEDFYHVRAKSQVSRSIKNMNMPVQPE<br>GDGKFAITVSKGGTESGNKRSAEKEAFKKFLSDYASLDERV<br>RDDMLRRMRRLVVLYFYGSDDSKLSDVNEKFDVWEDHAA<br>RRVDNREFIKLPLENKLANGKTDKDAERIRKNTVKELYRNQ<br>NIGCYRQAVKAVEEDNNGRYFDDKMLNMFFIHRIEYGVEKI<br>YANLKQVTEFKARTGYLSEKIWKDLINYISIKYIAMGKAVYN<br>YAMDELNASDKKEIELGKISEEYLSGISSFDYELIKAEEMLQR<br>ETAVYVAFAARHLSSQTVELDSENSDFLLLKPKGTMDKNDK<br>NKLASNNILNFLKDKETLRDTILQYFGGHSLWTDFPFDKYLA<br>GGKDDVDFLTDLKDVIYSMRNDSFHYATENHNNGKWNKEL<br>ISAMFEHETERMTVVMKDKFYSNNLPMFYKNDDLKKLLIDL<br>YKDNVERASQVPSFNKVFVRKNFPALVRDKDNLGIELDLKA<br>DADKGENELKFYNALYYMFKEIYYNAFLNDKNVRERFITKA<br>TKVADNYDRNKERNLKDRIKSAGSDEKKKLREQLQNYIAEN<br>DFGQRIKNIVQVNPDYTLAQICQLIMTEYNQQNNGCMQKKS<br>AARKDINKDSYQHYKMLLLVNLRKAFLEFIKENYAFVLKPY<br>KHDLCDKADFVPDFAKYVKPYAGLISRVAGSSELQKWYIVS<br>RFLSPAQANHMLGFLHSYKQYVWDIYRRASETGTEINHSIAE<br>DKIAGVDITDVDAVIDLSVKLCGTISSEISDYFKDDEVYAEYI<br>SSYLDFEYDGGNYKDSLNRFCNSDAVNDQKVALYYDGEHP<br>KLNRNIILSKLYGERRFLEKITDRVSRSDIVEYYKLKKETSQY<br>QTKGIFDSEDEQKNIKKFQEMKNIVEFRDLMDYSEIADELQG<br>QLINWIYLRERDLMNFQLGYHYACLNNDSNKQATYVTLDY |

TABLE 2-continued

| | | | |
|---|---|---|---|
| | | | QGKKNRKINGAILYQICAMYINGLPLYYVDKDSSEWTVSDG<br>KESTGAKIGEFYRYAKSFENTSDCYASGLEIFENISEHDNITEL<br>RNYIEHFRYYSSFDRSFLGIYSEVFDRFFTYDLKYRKNVPTIL<br>YNILLQHFVNVRFEFVSGKKMIGIDKKDRKIAKEKECARITIR<br>EKNGVYSEQFTYKLKNGTVYVDARDKRYLQSIIRLLFYPEK<br>VNMDEMIEVKEKKKPSDNNTGKGYSKRDRQQDRKEYDKY<br>KEKKKKEGNFLSGMGGNINWDEINAQLKN |
| c2c2-7 | 3 | [Clostridium]<br>aminophilum<br>DSM<br>10710<br>(SEQ ID<br>NO: 69) | MKFSKVDHTRSAVGIQKATDSVHGMLYTDPKKQEVNDLDK<br>RFDQLNVKAKRLYNVFNQSKAEEDDDEKRFGKVVKKLNRE<br>LKDLLFHREVSRYNSIGNAKYNYYGIKSNPEEIVSNLGMVES<br>LKGERDPQKVISKLLLYYLRKGLKPGTDGLRMILEASCGLRK<br>LSGDEKELKVFLQTLDEDFEKKTFKKNLIRSIENQNMAVQPS<br>NEGDPIIGITQGRFNSQKNEEKSAIERMMSMYADLNEDHRED<br>VLRKLRRLNVLYFNVDTEKTEEPTLPGEVDTNPVFEVWHDH<br>EKGKENDRQFATFAKILTEDRETRKKEKLAVKEALNDLKSAI<br>RDHNIMAYRCSIKVTEQDKDGLFFEDQRINRFWIHHIESAVE<br>RILASINPEKLYKLRIGYLGEKVWKDLLNYLSIKYIAVGKAV<br>FHFAMEDLGKTGQDIELGKLSNSVSGGLTSFDYEQIRADETL<br>QRQLSVEVAFAANNLFRAVVGQTGKKIEQSKSEENEEDFLL<br>WKAEKIAESIKKEGEGNTLKSILQFFGGASSWDLNHFCAAYG<br>NESSALGYETKFADDLRKAIYSLRNETFHFTTLNKGSFDWNA<br>KLIGDMFSHEAATGIAVERTRFYSNNLPMFYRESDLKRIMDH<br>LYNTYHPRASQVPSFNSVFVRKNFRLFLSNTLNTNTSFDTEV<br>YQKWESGVYYLFKEIYYNSFLPSGDAHHLFFEGLRRIRKEAD<br>NLPIVGKEAKKRNAVQDFGRRCDELKNLSLSAICQMIMTEY<br>NEQNNGNRKVKSTREDKRKPDIFQHYKMLLLRTLQEAFAIYI<br>RREEFKFIFDLPKTLYVMKPVEEFLPNWKSGMFDSLVERVK<br>QSPDLQRWYVLCKFLNGRLLNQLSGVIRSYIQFAGDIQRRAK<br>ANHNRLYMDNTQRVEYYSNVLEVVDFCIKGTSRFSNVFSDY<br>FRDEDAYADYLDNYLQFKDEKIAEVSSFAALKTFCNEEEVK<br>AGIYMDGENPVMQRNIVMAKLFGPDEVLKNVVPKVTREEIE<br>EYYQLEKQIAPYRQNGYCKSEEDQKKLLRFQRIKNRVEFQTI<br>TEFSEIINELLGQLISWSFLRERDLLYFQLGFHYLCLHNDTEK<br>PAEYKEISREDGTVIRNAILHQVAAMYVGGLPVYTLADKKL<br>AAFEKGEADCKLSISKDTAGAGKKIKDFFRYSKYVLIKDRML<br>TDQNQKYTIYLAGLELFENTDEHDNITDVRKYVDHFKYYAT<br>SDENAMSILDLYSEIHDRFFTYDMKYQKNVANMLENILLRH<br>FVLIRPEFFTGSKKVGEGKKITCKARAQIEIAENGMRSEDFTY<br>KLSDGKKNISTCMIAARDQKYLNTVARLLYYPHEAKKSIVD<br>TREKKNNKKTNRGDGTFNKQKGTARKEKDNGPREFNDTGF<br>SNTPFAGFDPFRNS |
| c2c2-8 | 5 | Carnobacterium<br>gallinarum<br>DSM 4847<br>(SEQ ID<br>NO: 70) | MRITKVKIKLDNKLYQVTMQKEEKYGTLKLNEESRKSTAEIL<br>RLKKASFNKSFHSKTINSQKENKNATIKKNGDYISQIFEKLVG<br>VDTNKNIRKPKMSLTDLKDLPKKDLALFIKRKFKNDDIVEIK<br>NLDLISLFYNALQKVPGEHFTDESWADFCQEMMPYREYKNK<br>FIERKIILLANSIEQNKGFSINPETFSKRKRVLHQWAIEVQERG<br>DFSILDEKLSKLAEIYNFKKMCKRVQDELNDLEKSMKKGKN<br>PEKEKEAYKKQKNFKIKTIWKDYPYKTHIGLIEKIKENEELN<br>QFNIEIGKYFEHYFPIKKERCTEDEPYYLNSETIATTVNYQLK<br>NALISYLMQIGKYKQFGLENQVLDSKKLQEIGIYEGFQTKFM<br>DACVFATSSLKNIIEPMRSGDILGKREFKEAIATSSFVNYHHF<br>FPYFPFELKGMKDRESELIPFGEQTEAKQMQNIWALRGSVQQ<br>IRNEIFHSFDKNQKFNLPQLDKSNFEFDASENSTGKSQSYIET<br>DYKFLFEAEKNQLEQFFIERIKSSGALEYYPLKSLEKLFAKKE<br>MKFSLGSQVVAFAPSYKKLVKKGHSYQTATEGTANYLGLS<br>YYNRYELKEESFQAQYYLLKLIYQYVFLPNFSQGNSPAFRET<br>VKAILRINKDEARKKMKKNKKFLRKYAFEQVREMEFKETPD<br>QYMSYLQSEMREEKVRKAEKNDKGFEKNITMNFEKLLMQIF<br>VKGFDVFLTTFAGKELLLSSEEKVIKETEISLSKKINEREKTLK<br>ASIQVEHQLVATNSAISYWLFCKLLDSRHLNELRNEMIKFKQ<br>SRIKFNHTQHAELIQNLLPIVELTILSNDYDEKNDSQNVDVSA<br>YFEDKSLYETAPYVQTDDRTRVSFRPILKLEKYHTKSLIEALL<br>KDNPQFRVAATDIQEWMHKREEIGELVEKRKNLHTEWAEG<br>QQTLGAEKREEYRDYCKKIDRFNWKANKVTLTYLSQLHYLI<br>TDLLGRMVGFSALFERDLVYFSRSFSELGGETYHISDYKNLS<br>GVLRLNAEVKPIKIKNIKVIDNEENPYKGNEPEVKPFLDRLH<br>AYLENVIGIKAVHGKIRNQTAHLSVLQLELSMIESMNNLRDL<br>MAYDRKLKNAVTKSMIKILDKHGMILKLKIDENHKNFEIESL<br>IPKEIIHLKDKAIKTNQVSEEYCQLVLALLTTNPGNQLN |
| c2c2-9 | 6 | Carnobacte<br>rium<br>gallinarum<br>DSM 4847<br>(SEQ ID<br>NO: 71) | MRMTKVKINGSPVSMNRSKLNGHLVWNGTTNTVNILTKKE<br>QSFAASFLNKTLVKADQVKGYKVLAENIFIIFEQLEKSNSEKP<br>SVYLNNIRRLKEAGLKRFFKSKYHEEIKYTSEKNQSVPTKLN<br>LIPLFFNAVDRIQEDKFDEKNWSYFCKEMSPYLDYKKSYLNR<br>KKEILANSIQQNRGFSMPTAEEPNLLSKRKQLFQQWAMKFQ<br>ESPLIQQNNFAVEQFNKEFANKINELAAVYNVDELCTAITEK<br>LMNFDKDKSNKTRNFEIKKLWKQHPHNKDKALIKLFNQEG<br>NEALNQFNIELGKYFEHYFPKTGKKESAESYYLNPQTIIKTVG |

TABLE 2-continued

| | | | |
|---|---|---|---|
| | | | YQLRNAFVQYLLQVGKLHQYNKGVLDSQTLQEIGMYEGFQ<br>TKFMDACVFASSSLRNIIQATTNEDILTREKFKKELEKNVELK<br>HDLFFKTEIVEERDENPAKKIAMTPNELDLWAIRGAVQRVR<br>NQIFHQQINKRHEPNQLKVGSFENGDLGNVSYQKTIYQKLFD<br>AEIKDIEIYFAEKIKSSGALEQYSMKDLEKLFSNKELTLSLGG<br>QVVAFAPSYKKLYKQGYFYQNEKTIELEQFTDYDFSNDVFK<br>ANYYLIKLIYHYVFLPQFSQANNKLFKDTVHYVIQQNKELNT<br>TEKDKKNNKKIRKYAFEQVKLMKNESPEKYMQYLQREMQE<br>ERTIKEAKKTNEEKPNYNFEKLLIQIFIKGFDTFLRNFDLNLNP<br>AEELVGTVKEKAEGLRKRKERIAKILNVDEQIKTGDEEIAFW<br>IFAKLLDARHLSELRNEMIKFKQSSVKKGLIKNGDLIEQMQPI<br>LELCILSNDSESMEKESFDKIEVFLEKVELAKNEPYMQEDKL<br>TPVKFRFMKQLEKYQTRNFIENLVIENPEFKVSEKIVLNWHE<br>EKEKIADLVDKRTKLHEEWASKAREIEEYNEKIKKNKSKKL<br>DKPAEFAKFAEYKIICEAIENFNRLDHKVRLTYLKNLHYLMI<br>DLMGRMVGFSVLFERDFVYMGRSYSALKKQSIYLNDYDTF<br>ANIRDWEVNENKHLFGTSSSDLTFQETAEFKNLKKPMENQL<br>KALLGVTNHSFEIRNNIAHLHVLRNDGKGEGVSLLSCMNDL<br>RKLMSYDRKLKNAVTKAIIKILDKHGMILKLTNNDHTKPFEI<br>ESLKPKKIIHLEKSNHSFPMDQVSQEYCDLVKKMLVFTN |
| c2c2-<br>10 | 7 | Paludibacter<br>propionicigenes<br>WB4<br>(SEQ ID<br>NO: 72) | MRVSKVKVKDGGKDKMVLVHRKTTGAQLVYSGQPVSNET<br>SNILPEKKRQSFDLSTLNKTIIKFDTAKKQKLNVDQYKIVEKI<br>FKYPKQELPKQIKAEEILPFLNHKFQEPVKYWKNGKEESFNL<br>TLLIVEAVQAQDKRKLQPYYDWKTWYIQTKSDLLKKSIENN<br>RIDLTENLSKRKKALLAWETEFTASGSIDLTHYHKVYMTDV<br>LCKMLQDVKPLTDDKGKINTNAYHRGLKKALQNHQPAIFGT<br>REVPNEANRADNQLSIYHLEVVKYLEHYFPIKTSKRRNTADD<br>IAHYLKAQTLKTTIEKQLVNAIRANIIQQGKTNHHELKADTT<br>SNDLIRIKTNEAFVLNLTGTCAFAANNIRNMVDNEQTNDILG<br>KGDFIKSLLKDNTNSQLYSFFFGEGLSTNKAEKETQLWGIRG<br>AVQQIRNNVNHYKKDALKTVFNISNFENPTITDPKQQTNYA<br>DTIYKARFINELEKIPEAFAQQLKTGGAVSYYTIENLKSLLTT<br>FQFSLCRSTIPFAPGFKKVFNGGINYQNAKQDESFYELMLEQ<br>YLRKENFAEESYNARYFMLKLIYNNLFLPGFTTDRKAFADSV<br>GFVQMQNKKQAEKVNPRKKEAYAFEAVRPMTAADSIADY<br>MAYVQSELMQEQNKKEEKVAEETRINFEKFVLQVFIKGFDS<br>FLRAKEFDFVQMPQPQLTATASNQQKADKLNQLEASITADC<br>KLTPQYAKADDATHIAFYVFCKLLDAAHLSNLRNELIKFRES<br>VNEFKFHHLLEIIEICLLSADVVPTDYRDLYSSEADCLARLRP<br>FIEQGADITNWSDLFVQSDKHSPVIHANIELSVKYGTTKLLEQ<br>IINKDTQFKTTEANFTAWNTAQKSIEQLIKQREDHHEQWVK<br>AKNADDKEKQERKREKSNFAQKFIEKHGDDYLDICDYINTY<br>NWLDNKMHFVHLNRLHGLTIELLGRMAGFVALFDRDFQFF<br>DEQQIADEFKLHGFVNLHSIDKKLNEVPTKKIKEIYDIRNKIIQ<br>INGNKINESVRANLIQFISSKRNYYNNAFLHVSNDEIKEKQM<br>YDIRNHIAHFNYLTKDAADFSLIDLINELRELLHYDRKLKNA<br>VSKAFIDLFDKHGMILKLKLNADHKLKVESLEPKKIYHLGSS<br>AKDKPEYQYCTNQVMMAYCNMCRSLLEMKK |
| c2c2-<br>11 | 9 | Listeria<br>weihenstep<br>hanensis<br>FSL R9-<br>0317<br>(SEQ ID<br>NO: 73) | MLALLHQEVPSQKLHNLKSLNTESLTKLFKPKFQNMISYPPS<br>KGAEHVQFCLTDIAVPAIRDLDEIKPDWGIFFEKLKPYTDWA<br>ESYIHYKQTTIQKSIEQNKIQSPDSPRKLVLQKYVTAFLNGEP<br>LGLDLVAKKYKLADLAESFKVVDLNEDKSANYKIKACLQQ<br>HQRNILDELKEDPELNQYGIEVKKYIQRYFPIKRAPNRSKHA<br>RADFLKKELIESTVEQQFKNAVYHYVLEQGKMEAYELTDPK<br>TKDLQDIRSGEAFSFKFINACAFASNNLKMILNPECEKDILGK<br>GDFKKNLPNSTTQSDVVKKMIPFFSDEIQNVNFDEAIWAIRG<br>SIQQIRNEVYHCKKHSWKSILKIKGFEFEPNNMKYTDSDMQK<br>LMDKDIAKIPDFIEEKLKSSGIIRFYSHDKLQSIWEMKQGFSL<br>LTTNAPFVPSFKRVYAKGHDYQTSKNRYYDLGLTTFDILEY<br>GEEDFRARYFLTKLVYYQQFMPWFTADNNAFRDAANFVLR<br>LNKNRQQDAKAFINIREVEEGEMPRDYMGYVQGQIAIHEDS<br>TEDTPNHFEKFISQVFIKGFDSHMRSADLKFIKNPRNQGLEQS<br>EIEEMSFDIKVEPSFLKNKDDYIAFWTFCKMLDARHLSELRN<br>EMIKYDGHLTGEQEIIGLALLGVDSRENDWKQFFSSEREYEK<br>IMKGYVGEELYQREPYRQSDGKTPILFRGVEQARKYGTETVI<br>QRLFDASPEFKVSKCNITEWERQKETIEETIERRKELHNEWE<br>KNPKKPQNNAFFKEYKECCDAIDAYNWHKNKTTLVYVNEL<br>HHLLIEILGRYVGYVAIADRDFQCMANQYFKHSGITERVEY<br>WGDNRLKSIKKLDTFLKKEGLFVSEKNARNHIAHLNYLSLK<br>SECTLLYLSERLREIFKYDRKLKNAVSKSLIDILDRHGMSVVF<br>ANLKENKHRLVIKSLEPKKLRHLGEKKIDNGYIETNQVSEEY<br>CGIVKRLLEI |
| c2c2-<br>12 | 10 | Listeriaceae<br>bacterium<br>FSL M6-<br>0635 =<br>Listeria | MKITKMRVDGRTIVMERTSKEGQLGYEGIDGNKTTEIIFDKK<br>KESFYKSILNKTVRKPDEKEKNRRKQAINKAINKEITELMLA<br>VLHQEVPSQKLHNLKSLNTESLTKLFKPKFQNMISYPPSKGA<br>EHVQFCLTDIAVPAIRDLDEIKPDWGIFFEKLKPYTDWAESYI<br>HYKQTTIQKSIEQNKIQSPDSPRKLVLQKYVTAFLNGEPLGL |

TABLE 2-continued

| | | | |
|---|---|---|---|
| | | newyorkensis FSL M6-0635(SEQ ID NO: 74) | DLVAKKYKLADLAESFKLVDLNEDKSANYKIKACLQQHQR<br>NILDELKEDPELNQYGIEVKKYIQRYFPIKRAPNRSKHARADF<br>LKKELIESTVEQQFKNAVYHYVLEQGKMEAYELTDPKTKDL<br>QDIRSGEAFSFKFINACAFASNNLKMILNPECEKDILGKGNFK<br>KNLPNSTTRSDVVKKMIPFFSDELQNVNFDEAIWAIRGSIQQI<br>RNEVYHCKKHSWKSILKIKGFEFEPNNMKYADSDMQKLMD<br>KDIAKIPEFIEEKLKSSGVVRFYRHDELQSIWEMKQGFSLLTT<br>NAPFVPSFKRVYAKGHDYQTSKNRYYNLDLTTFDILEYGEE<br>DFRARYFLTKLVYYQQFMPWFTADNNAFRDAANFVLRLNK<br>NRQQDAKAFINIREVEEGEMPRDYMGYVQGQIAIHEDSIEDT<br>PNHFEKFISQVFIKGFDRHMRSANLKFIKNPRNQGLEQSEIEE<br>MSFDIKVEPSFLKNKDDYIAFWIFCKMLDARHLSELRNEMIK<br>YDGHLTGEQEIIGLALLGVDSRENDWKQFFSSEREYEKIMKG<br>YVVEELYQREPYRQSDGKTPILFRGVEQARKYGTETVIQRLF<br>DANPEFKVSKCNLAEWERQKETIEETIKRRKELHNEWAKNP<br>KKPQNNAFFKEYKECCDAIDAYNWHKNKTTLAYVNELHHL<br>LIEILGRYVGYVAIADRDFQCMANQYFKHSGITERVEYWGD<br>NRLKSIKKLDTFLKKEGLFVSEKNARNHIAHLNYLSLKSECT<br>LLYLSERLREIFKYDRKLKNAVSKSLIDILDRHGMSVVFANL<br>KENKHRLVIKSLEPKKLRHLGGKKIDGGYIETNQVSEEYCGI<br>VKRLLEM |
| c2c2-13 | 12 | Leptotrichia wadei F0279 (SEQ ID NO: 75) | MKVTKVDGISHKKYIEEGKLVKSTSEENRTSERLSELLSIRLD<br>IYIKNPDNASEEENRIRRENLKKFFSNKVLHLKDSVLYLKNR<br>KEKNAVQDKNYSEEDISEYDLKNKNSFSVLKKILLNEDVNSE<br>ELEIFRKDVEAKLNKINSLKYSFEENKANYQKINENNVEKVG<br>GKSKRNIIYDYYRESAKRNDYINNVQEAFDKLYKKEDIEKLF<br>FLIENSKKHEKYKIREYYHKIIGRKNDKENFAKIIYEEIQNVN<br>NIKELIEKIPDMSELKKSQVFYKYYLDKEELNDKNIKYAFCH<br>FVEIEMSQLLKNYVYKRLSNISNDKIKRIFEYQNLKKLIENKL<br>LNKLDTYVRNCGKYNYYLQVGEIATSDFIARNRQNEAFLRNI<br>IGVSSVAYFSLRNILETENENDITGRMRGKTVKNNKGEEKYV<br>SGEVDKIYNENKQNEVKENLKMFYSYDFNMDNKNEIEDFFA<br>NIDEAISSIRHGIVHFNLELEGKDIFAFKNIAPSEISKKMFQNEI<br>NEKKLKLKIFKQLNSANVFNYYEKDVIIKYLKNTKFNFVNK<br>NIPFVPSFTKLYNKIEDLRNTLKFFWSVPKDKEEKDAQIYLLK<br>NIYYGEFLNKFVKNSKVFFKITNEVIKINKQRNQKTGHYKYQ<br>KFENIEKTVPVEYLAIIQSREMINNQDKEEKNTYIDFIQQIFLK<br>GFIDYLNKNNLKYIESNNNNDNNDIFSKIKIKKDNKEKYDKIL<br>KNYEKHNRNKEIPHEINEFVREIKLGKILKYTENLNMFYLILK<br>LLNHKELTNLKGSLEKYQSANKEETFSDELELINLLNLDNNR<br>VTEDFELEANEIGKFLDFNENKIKDRKELKKFDTNKIYFDGE<br>NIIKHRAFYNIKKYGMLNLLEKIADKAKYKISLKELKEYSNK<br>KNEIEKNYTMQQNLHRKYARPKKDEKFNDEDYKEYEKAIG<br>NIQKYTHLKNKVEFNELNLLQGLLLKILHRLVGYTSIWERDL<br>RFRLKGEFPENHYIEEIFNFDNSKNVKYKSGQIVEKYINFYKE<br>LYKDNVEKRSIYSDKKVKKLKQEKKDLYIRNYIAHFNYIPHA<br>EISLLEVLENLRKLLSYDRKLKNAIMKSIVDILKEYGFVATFK<br>IGADKKIEIQTLESEKIVHLKNLKKKKLMTDRNSEELCELVK<br>VMFEYKALE |
| c2c2-14 | 15 | Rhodobacter capsulatus SB 1003 (SEQ ID NO: 76) | MQIGKVQGRTISEFGDPAGGLKRKISTDGKNRKELPAHLSSD<br>PKALIGQWISGIDKIYRKPDSRKSDGKAIHSPTPSKMQFDARD<br>DLGEAFWKLVSEAGLAQDSDYDQFKRRLHPYGDKFQPADS<br>GAKLKFEADPPEPQAFHGRWYGAMSKRGNDAKELAAALYE<br>HLHVDEKRIDGQPKRNPKTDKFAPGLVVARALGIESSVLPRG<br>MARLARNWGEEEIQTYFVVDVAASVKEVAKAAVSAAQAFD<br>PPRQVSGRSLSPKVGFALAEHLERVTGSKRCSFDPAAGPSVL<br>ALHDEVKKTYKRLCARGKNAARAFPADKTELLALMRHTHE<br>NRVRNQMVRMGRVSEYRGQQAGDLAQSHYWTSAGQTEIK<br>ESEIFVRLWVGAFALAGRSMKAWIDPMGKIVNTEKNDRDLT<br>AAVNIRQVISNKEMVAEAMARRGIYFGETPELDRLGAEGNE<br>GFVFALLRYLRGCRNQTFHLGARAGFLKEIRKELEKTRWGK<br>AKEAEHVVLTDKTVAAIRAIIDNDAKALGARLLADLSGAFV<br>AHYASKEHFSTLYSEIVKAVKDAPEVSSGLPRLKLLLKRADG<br>VRGYVHGLRDTRKHAFATKLPPPPAPRELDDPATKARYIALL<br>RLYDGPFRAYASGITGTALAGPAARAKEAATALAQSVNVTK<br>AYSDVMEGRTSRLRPPNDGETLREYLSALTGETATEFRVQIG<br>YESDSENARKQAEFIENYRRDMLAFMFEDYIRAKGFDWILKI<br>EPGATAMTRAPVLPEPIDTRGQYEHWQAALYLVMHFVPASD<br>VSNLLHQLRKWEALQGKYELVQDGDATDQADARREALDL<br>VKRFRDVLVLFLKTGEARFEGRAAPFDLKPFRALFANPATFD<br>RLFMATPTTARPAEDDPEGDGASEPELRVARTLRGLRQIARY<br>NHMAVLSDLFAKHKVRDEEVARLAEIEDETQEKSQIVAAQE<br>LRTDLHDKVMKCHPKTISPEERQSYAAAIKTIEEHRFLVGRV<br>YLGDHLRLHRLMMDVIGRLIDYAGAYERDTGTFLINASKQL<br>GAGADWAVTIAGAANTDARTQTRKDLAHFNVLDRADGTPD<br>LTALVNRAREMMAYDRKRKNAVPRSILDMLARLGLTLKWQ<br>MKDHLLQDATITQAAIKHLDKVRLTVGGPAAVTEARFSQDY<br>LQMVAAVFNGSVQNPKPRRRDDGDAWHKPPKPATAQSQPD |

TABLE 2-continued

| | | | |
|---|---|---|---|
| | | | QKPPNKAPSAGSRLPPPQVGEVYEGVVVKVIDTGSLGFLAVE GVAGNIGLHISRLRRIREDAIIVGRRYRFRVEIYVPPKSNTSKL NAADLVRID |
| c2c2-15 | 16 | Rhodobacter capsulatus R121 (SEQ ID NO: 77) | MQIGKVQGRTISEFGDPAGGLKRKISTDGKNRKELPAHLSSD PKALIGQWISGIDKIYRKPDSRKSDGKAIHSPTPSKMQFDARD DLGEAFWKLVSEAGLAQDSDYDQFKRRLHPYGDKFQPADS GAKLKFEADPPEPQAFHGRWYGAMSKRGNDAKELAAALYE HLHVDEKRIDGQPKRNPKTDKFAPGLVVARALGIESSVLPRG MARLARNWGEEEIQTYFVVDVAASVKEVAKAAVSAAQAFD PPRQVSGRSLSPKVGFALAEHLERVTGSKRCSFDPAAGPSVL ALHDEVKKTYKRLCARGKNAARAFPADKTELLALMRHTHE NRVRNQMVRMGRVSEYRGQQAGDLAQSHYWTSAGQTEIK ESEIFVRLWVGAFALAGRSMKAWIDPMGKIVNTEKNDRDLT AAVNIRQVISNKEMVAEAMARRGIYFGETPELDRLGAEGNE GFVFALLRYLRGCRNQTFHLGARAGFLKEIRKELEKTRWGK AKEAEHVVLTDKTVAAIRAIIDNDAKALGARLLADLSGAFV AHYASKEHFSTLYSEIVKAVKDAPEVSSGLPRLKLLLKRADG VRGYVHGLRDTRKHAFATKLPPPPAPRELDDPATKARYIALL RLYDGPFRAYASGITGTALAGPAARAKEAATALAQSVNVTK AYSDVMEGRSSRLRPPNDGETLREYLSALTGETATEFRVQIG YESDSENARKQAEFIENYRRDMLAFMFEDYIRAKGFDWILKI EPGATAMTRAPVLPEPIDTRGQYEHWQAALYLVMHFVPASD VSNLLHQLRKWEALQGKYELVQDGDATDQADARREALDL VKRFRDVLVLFLKTGEARFEGRAAPFDLKPFRALFANPATFD RLFMATPTTARPAEDDPEGDGASEPELRVARTLRGLRQIARY NHMAVLSDLFAKHKVRDEEVARLAEIEDETQEKSQIVAAQE LRTDLHDKVMKCHPKTISPEERQSYAAAIKTIEEHRFLVGRV YLGDHLRLHRLMMDVIGRLIDYAGAYERDTGTFLINASKQL GAGADWAVTIAGAANTDARTQTRKDLAHFNVLDRADGTPD LTALVNRAREMMAYDRKRKNAVPRSILDMLARLGLTLKWQ MKDHLLQDATITQAAIKHLDKVRLTVGGPAAVTEARFSQDY LQMVAAVFNGSVQNPKPRRRDDGDAWHKPPKPATAQSQPD QKPPNKAPSAGSRLPPPQVGEVYEGVVVKVIDTGSLGFLAVE GVAGNIGLHISRLRRIREDAIIVGRRYRFRVEIYVPPKSNTSKL NAADLVRID |
| c2c2-16 | 17 | Rhodobacter capsulatus DE442 (SEQ ID NO: 78) | MQIGKVQGRTISEFGDPAGGLKRKISTDGKNRKELPAHLSSD PKALIGQWISGIDKIYRKPDSRKSDGKAIHSPTPSKMQFDARD DLGEAFWKLVSEAGLAQDSDYDQFKRRLHPYGDKFQPADS GAKLKFEADPPEPQAFHGRWYGAMSKRGNDAKELAAALYE HLHVDEKRIDGQPKRNPKTDKFAPGLVVARALGIESSVLPRG MARLARNWGEEEIQTYFVVDVAASVKEVAKAAVSAAQAFD PPRQVSGRSLSPKVGFALAEHLERVTGSKRCSFDPAAGPSVL ALHDEVKKTYKRLCARGKNAARAFPADKTELLALMRHTHE NRVRNQMVRMGRVSEYRGQQAGDLAQSHYWTSAGQTEIK ESEIFVRLWVGAFALAGRSMKAWIDPMGKIVNTEKNDRDLT AAVNIRQVISNKEMVAEAMARRGIYFGETPELDRLGAEGNE GFVFALLRYLRGCRNQTFHLGARAGFLKEIRKELEKTRWGK AKEAEHVVLTDKTVAAIRAIIDNDAKALGARLLADLSGAFV AHYASKEHFSTLYSEIVKAVKDAPEVSSGLPRLKLLLKRADG VRGYVHGLRDTRKHAFATKLPPPPAPRELDDPATKARYIALL RLYDGPFRAYASGITGTALAGPAARAKEAATALAQSVNVTK AYSDVMEGRSSRLRPPNDGETLREYLSALTGETATEFRVQIG YESDSENARKQAEFIENYRRDMLAFMFEDYIRAKGFDWILKI EPGATAMTRAPVLPEPIDTRGQYEHWQAALYLVMHFVPASD VSNLLHQLRKWEALQGKYELVQDGDATDQADARREALDL VKRFRDVLVLFLKTGEARFEGRAAPFDLKPFRALFANPATFD RLFMATPTTARPAEDDPEGDGASEPELRVARTLRGLRQIARY NHMAVLSDLFAKHKVRDEEVARLAEIEDETQEKSQIVAAQE LRTDLHDKVMKCHPKTISPEERQSYAAAIKTIEEHRFLVGRV YLGDHLRLHRLMMDVIGRLIDYAGAYERDTGTFLINASKQL GAGADWAVTIAGAANTDARTQTRKDLAHFNVLDRADGTPD LTALVNRAREMMAYDRKRKNAVPRSILDMLARLGLTLKWQ MKDHLLQDATITQAAIKHLDKVRLTVGGPAAVTEARFSQDY LQMVAAVFNGSVQNPKPRRRDDGDAWHKPPKPATAQSQPD QKPPNKAPSAGSRLPPPQVGEVYEGVVVKVIDTGSLGFLAVE GVAGNIGLHISRLRRIREDAIIVGRRYRFRVEIYVPPKSNTSKL NAADLVRID |
| c2c2-2 | | (SEQ ID NO: 79) | MGNLFGHKRWYEVRDKKDFKIKRKVKVKRNYDGNKYILNI NENNNKEKIDNNKFIRKYINYKKNDNILKEFTRKFHAGNILF KLKGKEGIIRIENNDDFLETEEVVLYIEAYGKSEKLKALGITK KKIIDEAIRQGITKDDKKIEIKRQENEEEIEIDIRDEYTNKTLND CSIILRIIENDELETKKSIYEIFKNINMS- LYKIIEKIIENETEKVFE NRYYEEHLREKLLKDDKIDVILTNFMEIREKIKSNLEILGFVK FYLNVGGDKKKSKNKKMLVEKILNINVDLTVEDIADFVIKEL EFWNITKRIEKVKKVNNEFLEKRRNRTYIKSYVLLDKHEKFK IERENKKDKIVKFFVENIKNNSIKEKIEKILAEFKIDELIKKLEK |

TABLE 2-continued

| | | |
|---|---|---|
| | | ELKKGNCDTEIFGIFKKHYKVNFDSKKFSKKSDEEKELYKIIY<br>RYLKGRIEKILVNEQKVRLKKMEKIEIEKILNESILSEKILKRV<br>KQYTLEHIMYLGKLRHNDIDMTTVNTDDFSRLHAKEELDLE<br>LITFFASTNMELNKIFSRENINNDENIDFFGGDREKNYVLDKK<br>ILNSKIKIIRDLDFIDNKNNITNNFIRKFTKIGTNERNRILHAISK<br>ERDLQGTQDDYNKVINIIQNLKISDEEVSKALNLDVVFKDKK<br>NIITKINDIKISEENNNDIKYLPSFSKVLPEILNLYRNNPKNEPF<br>DTIETEKIVLNALIYVNKELYKKLILEDDLEENESKNIFLQELK<br>KTLGNIDEIDENIIENYYKNAQISASKGNNKAIKKYQKKVIEC<br>YIGYLRKNYEELFDFSDFKMNIQEIKKQIKDINDNKTYERITV<br>KTSDKTIVINDDFEYIISIFALLNSNAVINKIRNRFFATSVWLN<br>TSEYQNIIDILDEIMQLNTLRNECITENWNLNLEEFIQKMKEIE<br>KDFDDFKIQTKKEIFNNYYEDIKNNILTEFKDDINGCDVLEKK<br>LEKIVIFDDETKFEIDKKSNILQDEQRKLSNINKKDLKKKVDQ<br>YIKDKDQEIKSKILCRIIFNSDFLKKYKKEIDNLIEDMESENEN<br>KFQEIYYPKERKNELYIYKKNLFLNIGNPNFDKIYGLISNDIK<br>MADAKFLFNIDGKNIRKNKISEIDAILKNLNDKLNGYSKEYK<br>EKYIKKLKENDDFFAKNIQNKNYKSFEKDYNRVSEYKKIRD<br>LVEFNYLNKIESYLIDINWKLAIQMARFERDMHYIVNGLREL<br>GIIKLSGYNTGISRAYPKRNGSDGFYTTTAYYKFFDEESYKKF<br>EKICYGFGIDLSENSEINKPENESIRNYISHFYIVRNPFADYSIA<br>EQIDRVSNLLSYSTRYNNSTYASVFEVFKKDVNLDYDELKK<br>KFKLIGNNDILERLMKPKKVSVLELESYNSDYIKNLIIELLTKI<br>ENTNDTL |
| c2c2-3 | L wadei<br>(Lw2)<br>(SEQ ID<br>NO: 80) | MKVTKVDGISHKKYIEEGKLVKSTSEENRTSERLSELLSIRLD<br>IYIKNPDNASEEENRIRRENLKKFFSNKVLHLKDSVLYLKNR<br>KEKNAVQDKNYSEEDISEYDLKNKNSFSVLKKILLNEDVNSE<br>ELEIFRKDVEAKLNKINSLKYSFEENKANYQKINENNVEKVG<br>GKSKRNIIYDYYRESAKRNDYINNVQEAFDKLYKKEDIEKLF<br>FLIENSKKHEKYKIREYYHKIIGRKNDKENFAKIIYEEIQNVN<br>NIKELIEKIPDMSELKKSQVFYKYYLDKEELNDKNIKYAFCH<br>FVEIEMSQLLKNYVYKRLSNISNDKIKRIFEYQNLKKLIENKL<br>LNKLDTYVRNCGKYNYYLQVGEIATSDFIARNRQNEAFLRNI<br>IGVSSVAYFSLRNILETENENDITGRMRGKTVKNNKGEEKYV<br>SGEVDKIYNENKQNEVKENLKMFYSYDFNMDNKNEIEDFFA<br>NIDEAISSIRHGIVHFNLELEGKDIFAFKNIAPSEISKKMFQNEI<br>NEKKLKLKIFKQLNSANVFNYYEKDVIIKYLKNTKFNFVNK<br>NIPFVPSFTKLYNKIEDLRNTLKFFWSVPKDKEEKDAQIYLLK<br>NIYYGEFLNKFVKNSKVFFKITNEVIKINKQRNQKTGHYKYQ<br>KFENIEKTVPVEYLAIIQSREMINNQDKEEKNTYIDFIQQIFLK<br>GFIDYLNKNNLKYIESNNNNDNNDIFSKIKIKKDNKEKYDKIL<br>KNYEKHNRNKEIPHEINEFVREIKLGKILKYTENLNMFYLILK<br>LLNHKELTNLKGSLEKYQSANKEETFSDELELINLLNLDNNR<br>VTEDFELEANEIGKFLDFNENKIKDRKELKKFDTNKIYFDGE<br>NIIKHRAFYNIKKYGMLNLLEKIADKAKYKISLKELKEYSNK<br>KNEIEKNYTMQQNLHRKYARPKKDEKFNDEDYKEYEKAIG<br>NIQKYTHLKNKVEFNELNLLQGLLLKILHRLVGYTSIWERDL<br>RFRLKGEFPENHYIEEIFNFDNSKNVKYKSGQIVEKYINFYKE<br>LYKDNVEKRSIYSDKKVKKLKQEKKDLYIRNYIAHFNYIPHA<br>EISLLEVLENLRKLLSYDRKLKNAIMKSIVDILKEYGFVATFK<br>IGADKKIEIQTLESEKIVHLKNLKKKKLMTDRNSEELCELVK<br>VMFEYKALEKRPAATKKAGQAKKKKGSYPYDVPDYAYPY<br>DVPDYAYPYDVPDYA* |
| c2c2-4 | Listeria<br>seeligeri<br>(SEQ ID<br>NO: 81) | MWISIKTLIHHLGVLFFCDYMYNRREKKIIEVKTMRITKVEV<br>DRKKVLISRDKNGGKLVYENEMQDNTEQIMHHKKSSFYKS<br>VVNKTICRPEQKQMKKLVHGLLQENSQEKIKVSDVTKLNIS<br>NFLNHRFKKSLYYFPENSPDKSEEYRIEINLSQLLEDSLKKQQ<br>GTFICWESFSKDMELYINWAENYISSKTKLIKKSIRNNRIQST<br>ESRSGQLMDRYMKDILNKNKPFDIQSVSEKYQLEKLTSALK<br>ATFKEAKKNDKEINYKLKSTLQNHERQIIEELKENSELNQFNI<br>EIRKHLETYFPIKKTNRKVGDIRNLEIGEIQKIVNHRLKNKIVQ<br>RILQEGKLASYEIESTVNSNSLQKIKIEEAFALKFINACLFASN<br>NLRNMVYPVCKKDILMIGEFKNSFKEIKHKKFIRQWSQFFSQ<br>EITVDDIELASWGLRGAIAPIRNEIIHLKKHSWKKFFNNPTFK<br>VKKSKIINGKTKDVTSEFLYKETLFKDYFYSELDSVPELIINK<br>MESSKILDYYSSDQLNQVFTIPNFELSLLTSAVPFAPSFKRVY<br>LKGFDYQNQDEAQPDYNLKLNIYNEKAFNSEAFQAQYSLFK<br>MVYYQVFLPQFTTNNDLFKSSVDFILTLNKERKGYAKAFQDI<br>RKMNKDEKPSEYMSYIQSQLMLYQKKQEEKEKINHFEKFIN<br>QVFIKGFNSFIEKNRLTYICHPTKNTVPENDNIEIPFHTDMDDS<br>NIAFWLMCKLLDAKQLSELRNEMIKFSCSLQSTEEISTFTKAR<br>EVIGLALLNGEKGCNDWKELFDDKEAWKKNMSLYVSEELL<br>QSLPYTQEDGQTPVINRSIDLVKKYGTETILEKLFSSSDDYKV<br>SAKDIAKLHEYDVTEKIAQQESLHKQWIEKPGLARDSAWTK<br>KYQNVINDISNYQWAKTKVELTQVRHLHQLTIDLLSRLAGY<br>MSIADRDFQFSSNYILERENSEYRVTSWILLSENKNKNKYND<br>YELYNLKNASIKVSSKNDPQLKVDLKQLRLTLEYLELFDNRL<br>KEKRNNISHFNYLNGQLGNSILELFDDARDVLSYDRKLKNA |

TABLE 2-continued

| | | |
|---|---|---|
| | | VSKSLKEILSSHGMEVTFKPLYQTNHHLKIDKLQPKKIHHLG<br>EKSTVSSNQVSNEYCQLVRTLLTMK |
| C2-17 | Leptotrichia buccalis C-1013-b (SEQ ID NO: 82) | MKVTKVGGISHKKYTSEGRLVKSESEENRTDERLSALLNMR<br>LDMYIKNPSSTETKENQKRIGKLKKFFSNKMVYLKDNTLSL<br>KNGKKENIDREYSETDILESDVRDKKNFAVLKKIYLNENVNS<br>EELEVFRNDIKKKLNKINSLKYSFEKNKANYQKINENNIEKV<br>EGKSKRNIIYDYYRESAKRDAYVSNVKEAFDKLYKEEDIAK<br>LVLEIENLTKLEKYKIREFYHEIIGRKNDKENFAKIIYEEIQNV<br>NNMKELIEKVPDMSELKKSQVFYKYYLDKEELNDKNIKYAF<br>CHFVEIEMSQLLKNYVYKRLSNISNDKIKRIFEYQNLKKLIEN<br>KLLNKLDTYVRNCGKYNYYLQDGEIATSDFIARNRQNEAFL<br>RNIIGVSSVAYFSLRNILETENENDITGRMRGKTVKNNKGEE<br>KYVSGEVDKIYNENKKNEVKENLKMFYSYDFNMDNKNEIE<br>DFFANIDEAISSIRHGIVHFNLELEGKDIFAFKNIAPSEISKKMF<br>QNEINEKKLKLKIFRQLNSANVFRYLEKYKILNYLKRTRFEF<br>VNKNIPFVPSFTKLYSRIDDLKNSLGIYWKTPKTNDDNKTKEI<br>IDAQIYLLKNIYYGEFLNYFMSNNGNFFEISKEIIELNKNDKR<br>NLKTGFYKLQKFEDIQEKIPKEYLANIQSLYMINAGNQDEEE<br>KDTYIDFIQKIFLKGFMTYLANNGRLSLIYIGSDEETNTSLAE<br>KKQEFDKFLKKYEQNNNIKIPYEINEFLREIKLGNILKYTERL<br>NMFYLILKLLNHKELTNLKGSLEKYQSANKEEAFSDQLELIN<br>LLNLDNNRVTEDFELEADEIGKFLDFNGNKVKDNKELKKFD<br>TNKIYFDGENIIKHRAFYNIKKYGMLNLLEKIADKAGYKISIE<br>ELKKYSNKKNEIEKNHKMQENLHRKYARPRKDEKFTDEDY<br>ESYKQAIENIEEYTHLKNKVEFNELNLLQGLLLRILHRLVGY<br>TSIWERDLRFRLKGEFPENQYIEEIFNFENKKNVKYKGGQIVE<br>KYIKFYKELHQNDEVKINKYSSANIKVLKQEKKDLYIRNYIA<br>HFNYIPHAEISLLEVLENLRKLLSYDRKLKNAVMKSVVDILK<br>EYGFVATFKIGADKKIGIQTLESEKIVHLKNLKKKKLMTDRN<br>SEELCKLVKIMFEYKMEEKKSEN |
| C2-18 | Herbinix hemicellulo silytica (SEQ ID NO: 83) | MKLTRRRISGNSVDQKITAAFYRDMSQGLLYYDSEDNDCTD<br>KVIESMDFERSWRGRILKNGEDDKNPFYMFVKGLVGSNDKI<br>VCEPIDVDSDPDNLDILINKNLTGFGRNLKAPDSNDTLENLIR<br>KIQAGIPEEEVLPELKKIKEMIQKDIVNRKEQLLKSIKNNRIPF<br>SLEGSKLVPSTKKMKWLFKLIDVPNKTFNEKMLEKYWEIYD<br>YDKLKANITNRLDKTDKKARSISRAVSEELREYHKNLRTNY<br>NRFVSGDRPAAGLDNGGSAKYNPDKEEFLLFLKEVEQYFKK<br>YFPVKSKHSNKSKDKSLVDKYKNYCSYKVVKKEVNRSIINQ<br>LVAGLIQQGKLLYYFYYNDTWQEDFLNSYGLSYIQVEEAFK<br>KSVMTSLSWGINRLTSFFIDDSNTVKFDDITTKKAKEAIESNY<br>FNKLRTCSRMQDHFKEKLAFFYPVYVKDKKDRPDDDIENLI<br>VLVKNAIESVSYLRNRTFHFKESSLLELLKELDDKNSGQNKI<br>DYSVAAEFIKRDIENLYDVFREQIRSLGIAEYYKADMISDCFK<br>TCGLEFALYSPKNSLMPAFKNVYKRGANLNKAYIRDKGPKE<br>TGDQGQNSYKALEEYRELTWYIEVKNNDQSYNAYKNLLQLI<br>YYHAFLPEVRENEALITDFINRTKEWNRKETEERLNTKNNKK<br>HKNFDENDDITVNTYRYESIPDYQGESLDDYLKVLQRKQMA<br>RAKEVNEKEEGNNNYIQFIRDVVVWAFGAYLENKLKNYKN<br>ELQPPLSKENIGLNDTLKELFPEEKVKSPFNIKCRFSISTFIDNK<br>GKSTDNTSAEAVKTDGKEDEKDKKNIKRKDLLCFYLFLRLL<br>DENEICKLQHQFIKYRCSLKERRFPGNRTKLEKETELLAELEE<br>LMELVRFTMPSIPEISAKAESGYDTMIKKYFKDFIEKKVFKNP<br>KTSNLYYHSDSKTPVTRKYMALLMRSAPLHLYKDIFKGYYL<br>ITKKECLEYIKLSNIIKDYQNSLNELHEQLERIKLKSEKQNGK<br>DSLYLDKKDFYKVKEYVENLEQVARYKHLQHKINFESLYRI<br>FRIHVDIAARMVGYTQDWERDMHFLFKALVYNGVLEERRF<br>EAIFNNNDDNNDGRIVKKIQNNLNNKNRELVSMLCWNKKL<br>NKNEFGAIIWKRNPIAHLNHFTQTEQNSKSSLESLINSLRILLA<br>YDRKRQNAVTKTINDLLLNDYHIRIKWEGRVDEGQIYFNIKE<br>KEDIENEPIIHLKHLHKKDCYIYKNSYMFDKQKEWICNGIKE<br>EVYDKSILKCIGNLFKFDYEDKNKSSANPKHT |
| C2-19 | [Eubacterium] rectale (SEQ ID NO: 84) | MLRRDKEVKKLYNVFNQIQVGTKPKKWNNDEKLSPEENER<br>RAQQKNIKMKNYKWREACSKYVESSQRIINDVIFYSYRKAK<br>NKLRYMRKNEDILKKMQEAEKLSKFSGGKLEDFVAYTLRKS<br>LVVSKYDTQEFDSLAAMVVFLECIGKNNISDHEREIVCKLLE<br>LIRKDFSKLDPNVKGSQGANIVRSVRNQNMIVQPQGDRFLFP<br>QVYAKENETVTNKNVEKEGLNEFLLNYANLDDEKRAESLR<br>KLRRILDVYFSAPNHYEKDMDITLSDNIEKEKFNVWEKHEC<br>GKKETGLFVDIPDVLMEAEAENIKLDAVVEKRERKVLNDRV<br>RKQNIICYRYTRAVVEKYNSNEPLFFENNAINQYWIHHIENA<br>VERILKNCKAGKLFKLRKGYLAEKVWKDAINLISIKYIALGK<br>AVYNFALDDIWKDKKNKELGIVDERIRNGITSFDYEMIKAHE<br>NLQRELAVDIAFSVNNLARAVCDMSNLGNKESDFLLWKRN<br>DIADKLKNKDDMASVSAVLQFFGGKSSWDINIFKDAYKGKK<br>KYNYEVRFIDDLRKAIYCARNENFHFKTALVNDEKWNTELF<br>GKIFERETEFCLNVEKDRFYSNNLYMFYQVSELRNMLDHLY<br>SRSVSRAAQVPSYNSVIVRTAFPEYITNVLGYQKPSYDADTL |

TABLE 2-continued

| | | |
|---|---|---|
| | | GKWYSACYYLLKEIYYNSFLQSDRALQLFEKSVKTLSWDDK<br>KQQRAVDNFKDHFSDIKSACTSLAQVCQIYMTEYNQQNNQI<br>KKVRSSNDSIFDQPVYQHYKVLLKKAIANAFADYLKNNKDL<br>FGFIGKPFKANEIREIDKEQFLPDWTSRKYEALCIEVSGSQEL<br>QKWYIVGKFLNARSLNLMVGSMRSYIQYVTDIKRRAASIGN<br>ELHVSVHDVEKVEKWVQVIEVCSLLASRTSNQFEDYFNDKD<br>DYARYLKSYVDFSNVDMPSEYSALVDFSNEEQSDLYVDPKN<br>PKVNRNIVHSKLFAADHILRDIVEPVSKDNIEEFYSQKAEIAY<br>CKIKGKEITAEEQKAVLKYQKLKNRVELRDIVEYGEIINELLG<br>QLINWSFMRERDLLYFQLGFHYDCLRNDSKKPEGYKNIKVD<br>ENSIKDAILYQIIGMYVNGVTVYAPEKDGDKLKEQCVKGGV<br>GVKVSAFHRYSKYLGLNEKTLYNAGLEIFEVVAEHEDIINLR<br>NGIDHFKYYLGDYRSMLSIYSEVFDRFFTYDIKYQKNVLNLL<br>QNILLRHNVIVEPILESGFKTIGEQTKPGAKLSIRSIKSDTFQY<br>KVKGGTLITDAKDERYLETIRKILYYAENEEDNLKKSVVVTN<br>ADKYEKNKESDDQNKQKEKKNKDNKGKKNEETKSDAEKN<br>NNERLSYNPFANLNFKLSN |
| C2-20 | Eubacteriaceae bacterium CHKCI004 (SEQ ID NO: 85) | MKISKESHKRTAVAVMEDRVGGVVYVPGGSGIDLSNNLKK<br>RSMDTKSLYNVFNQIQAGTAPSEYEWKDYLSEAENKKREAQ<br>KMIQKANYELRRECEDYAKKANLAVSRIIFSKKPKKIFSDDDI<br>ISHMKKQRLSKFKGRMEDFVLIALRKSLVVSTYNQEVFDSR<br>KAATVFLKNIGKKNISADDERQIKQLMALIREDYDKWNPDK<br>DSSDKKESSGTKVIRSIEHQNMVIQPEKNKLSLSKISNVGKKT<br>KTKQKEKAGLDAFLKEYAQIDENSRMEYLKKLRRLLDTYFA<br>APSSYIKGAAVSLPENINFSSELNVWERHEAAKKVNINFVEIP<br>ESLLNAEQNNNKINKVEQEHSLEQLRTDIRRRNITCYHFANA<br>LAADERYHTLFFENMAMNQFWIHHMENAVERILKKCNVGT<br>LFKLRIGYLSEKVWKDMLNLLSIKYIALGKAVYHFALDDIW<br>KADIWKDASDKNSGKINDLTLKGISSFDYEMVKAQEDLQRE<br>MAVGVAFSTNNLARVTCKMDDLSDAESDFLLWNKEAIRRH<br>VKYTEKGEILSAILQFFGGRSLWDESLFEKAYSDSNYELKFL<br>DDLKRAIYAARNETFHFKTAAIDGGSWNTRLFGSLFEKEAGL<br>CLNVEKNKFYSNNLVLFYKQEDLRVFLDKLYGKECSRAAQI<br>PSYNTILPRKSFSDFMKQLLGLKEPVYGSAILDQWYSACYYL<br>FKEVYYNLFLQDSSAKALFEKAVKALKGADKKQEKAVESFR<br>KRYWEISKNASLAEICQSYITEYNQQNNKERKVRSANDGMF<br>NEPIYQHYKMLLKEALKMAFASYIKNDKELKFVYKPTEKLF<br>EVSQDNFLPNWNSEKYNTLISEVKNSPDLQKWYIVGKFMNA<br>RMLNLLLGSMRSYLQYVSDIQKRAAGLGENQLHLSAENVG<br>QVKKWIQVLEVCLLLSVRISDKFTDYFKDEEEYASYLKEYV<br>DFEDSAMPSDYSALLAFSNEGKIDLYVDASNPKVNRNIIQAK<br>LYAPDMVLKKVVKKISQDECKEFNEKKEQIMQFKNKGDEVS<br>WEEQQKILEYQKLKNRVELRDLSEYGELINELLGQLINWSYL<br>RERDLLYFQLGFHYSCLMNESKKPDAYKTIRRGTVSIENAVL<br>YQIIAMYINGFPVYAPEKGELKPQCKTGSAGQKIRAFCQWAS<br>MVEKKKYELYNAGLELFEVVKEHDNIIDLRNKIDHFKYYQG<br>NDSILALYGEIFDRFFTYDMKYRNNVLNHLQNILLRHNVIIKP<br>IISKDKKEVGRGKMKDRAAFLLEEVSSDRFTYKVKEGERKID<br>AKNRLYLETVRDILYFPNRAVNDKGEDVIICSKKAQDLNEK<br>KADRDKNHDKSKDTNQKKEGKNQEEKSENKEPYSDRMTW<br>KPFAGIKLE |
| C2-21 | Blautia sp. Marseille-P2398 (SEQ ID NO: 86) | MKISKVDHVKSGIDQKLSSQRGMLYKQPQKKYEGKQLEEH<br>VRNLSRKAKALYQVFPVSGNSKMEKELQIINSFIKNILLRLDS<br>GKTSEEIVGYINTYSVASQISGDHIQELVDQHLKESLRKYTCV<br>GDKRIYVPDIIVALLKSKFNSETLQYDNSELKILIDFIREDYLK<br>EKQIKQIVHSIENNSTPLRIAEINGQKRLIPANVDNPKKSYIFE<br>FLKEYAQSDPKGQESLLQHMRYLILLYLYGPDKITDDYCEEI<br>EAWNFGSIVMDNEQLFSEEASMLIQDRIYVNQQIEEGRQSKD<br>TAKVKKNKSKYRMLGDKIEHSINESVVKHYQEACKAVEEK<br>DIPWIKYISDHVMSVYSSKNRVDLDKLSLPYLAKNTWNTWI<br>SFIAMKYVDMGKGVYHFAMSDVDKVGKQDNLIIGQIDPKFS<br>DGISSFDYERIKAEDDLHRSMSGYIAFAVNNFARAICSDEFRK<br>KNRKEDVLTVGLDEIPLYDNVKRKLLQYFGGASNWDDSIIDI<br>IDDKDLVACIKENLYVARNVNFHFAGSEKVQKKQDDILEEIV<br>RKETRDIGKHYRKVFYSNNVAVFYCDEDIIKLMNHLYQREK<br>PYQAQIPSYNKVISKTYLPDLIFMLLKGKNRTKISDPSIMNMF<br>RGTFYFLLKEIYYNDFLQASNLKEMFCEGLKNNVKNKKSEK<br>PYQNFMRRFEELENMGMDFGEICQQIMTDYEQQNKQKKKT<br>ATAVMSEKDKKIRTLDNDTQKYKHFRTLLYIGLREAFIIYLK<br>DEKNKEWYEFLREPVKREQPEEKEFVNKWKLNQYSDCSELI<br>LKDSLAAAWYVVAHFINQAQLNHLIGDIKNYIQFISDIDRRA<br>KSTGNPVSESTEIQIERYRKILRVLEFAKFFCGQITNVLTDYY<br>QDENDFSTHVGHYVKFEKKNMEPAHALQAFSNSLYACGKE<br>KKKAGFYYDGMNPIVNRNITLASMYGNKKLLENAMNPVTE<br>QDIRKYYSLMAELDSVLKNGAVCKSEDEQKNLRHFQNLKN<br>RIELVDVLTLSELVNDLVAQLIGWVYIRERDMMYLQLGLHY<br>IKLYFTDSVAEDSYLRTLDLEEGSIADGAVLYQIASLYSFNLP<br>MYVKPNKSSVYCKKHVNSVATKFDIFEKEYCNGDETVIENG |

TABLE 2-continued

| | | |
|---|---|---|
| | | LRLFENINLHKDMVKFRDYLAHFKYFAKLDESILELYSKAYD<br>FFFSYNIKLKKSVSYVLTNVLLSYFINAKLSFSTYKSSGNKTV<br>QHRTTKISVVAQTDYFTYKLRSIVKNKNGVESIENDDRRCEV<br>VNIAARDKEFVDEVCNVINYNSDK |
| C2-22 | Leptotrichia sp. oral taxon 879 str. F0557 (SEQ ID NO: 87) | MGNLFGHKRWYEVRDKKDFKIKRKVKVKRNYDGNKYILNI<br>NENNNKEKIDNNKFIGEFVNYKKNNNVLKEFKRKFHAGNIL<br>FKLKGKEEIIRIENNDDFLETEEVVLYIEVYGKSEKLKALEITK<br>KKIIDEAIRQGITKDDKKIEIKRQENEEEIEIDIRDEYTNKTLND<br>CSIILRIIENDELETKKSIYEIFKNINMS-<br>LYKIIEKIIENETEKVFE<br>NRYYEEHLREKLLKDNKIDVILTNFMEIREKIKSNLEIMGFVK<br>FYLNVSGDKKKSENKKMFVEKILNTNVDLTVEDIVDFIVKEL<br>KFWNITKRIEKVKKFNNEFLENRRNRTYIKSYVLLDKHEKFK<br>IERENKKDKIVKFFVENIKNNSIKEKIEKILAEFKINELIKKLEK<br>ELKKGNCDTEIFGIFKKHYKVNFDSKKFSNKSDEEKELYKIIY<br>RYLKGRIEKILVNEQKVRLKKMEKIEIEKILNESILSEKILKRV<br>KQYTLEHIMYLGKLRHNDIVKMTVNTDDFSRLHAKEELDLE<br>LITFFASTNMELNKIFNGKEKVTDFFGFNLNGQKITLKEKVPS<br>FKLNILKKLNFINNENNIDEKLSHFYSFQKEGYLLRNKILHNS<br>YGNIQETKNLKGEYENVEKLIKELKVSDEEISKSLSLDVIFEG<br>KVDIINKINSLKIGEYKDKKYLPSFSKIVLEITRKFREINKDKL<br>FDIESEKIILNAVKYVNKILYEKITSNEENEFLKTLPDKLVKKS<br>NNKKENKNLLSIEEYYKNAQVSSSKGDKKAIKKYQNKVTNA<br>YLEYLENTFTEIIDFSKFNLNYDEIKTKIEERKDNKSKIIIDSIST<br>NINITNDIEYIISIFALLNSNTYINKIRNRFFATSVWLEKQNGTK<br>EYDYENIISILDEVLLINLLRENNITDILDLKNAIIDAKIVENDE<br>TYIKNYIFESNEEKLKKRLFCEELVDKEDIRKIFEDENFKFKSF<br>IKKNEIGNFKINFGILSNLECNSEVEAKKIIGKNSKKLESFIQNI<br>IDEYKSNIRTLFSSEFLEKYKEEIDNLVEDTESENKNKFEKIYY<br>PKEHKNELYIYKKNLFLNIGNPNFDKIYGLISKDIKNVDTKIL<br>FDDDIKKNKISEIDAILKNLNDKLNGYSNDYKAKYVNKLKE<br>NDDFFAKNIQNENYSSFGEFEKDYNKVSEYKKIRDLVEFNYL<br>NKIESYLIDINWKLAIQMARFERDMHYIVNGLRELGIIKLSGY<br>NTGISRAYPKRNGSDGFYTTTAYYKFFDEESYKKFEKICYGF<br>GIDLSENSEINKPENESIRNYISHFYIVRNPFADYSIAEQIDRVS<br>NLLSYSTRYNNSTYASVFEVFKKDVNLDYDELKKKFRLIGN<br>NDILERLMKPKKVSVLELESYNSDYIKNLIIELLTKIENTNDTL |
| C2-23 | Lachnospiraceae bacterium NK4A144 (SEQ ID NO: 88) | MKISKVDHTRMAVAKGNQHRRDEISGILYKDPTKTGSIDFDE<br>RFKKLNCSAKILYHVENGIAEGSNKYKNIVDKVNNNLDRVL<br>FTGKSYDRKSIIDIDTVLRNVEKINAFDRISTEEREQIIDDLLEI<br>QLRKGLRKGKAGLREVLLIGAGVIVRTDKKQEIADFLEILDE<br>DFNKTNQAKNIKLSIENQGLVVSPVSRGEERIFDVSGAQKGK<br>SSKKAQEKEALSAFLLDYADLDKNVRFEYLRKIRRLINLYFY<br>VKNDDVMSLTEIPAEVNLEKDFDIWRDHEQRKEENGDFVGC<br>PDILLADRDVKKSNSKQVKIAERQLRESIREKNIKRYRFSIKTI<br>EKDDGTYFFANKQISVFWIHRIENAVERILGSINDKKLYRLRL<br>GYLGEKVWKDILNFLSIKYIAVGKAVFNFAMDDLQEKDRDI<br>EPGKISENAVNGLTSFDYEQIKADEMLQREVAVNVAFAANN<br>LARVTVDIPQNGEKEDILLWNKSDIKKYKKNSKKGILKSILQ<br>FFGGASTWNMKMFEIAYHDQPGDYEENYLYDIIQIIYSLRNK<br>SFHFKTYDHGDKNWNRELIGKMIEHDAERVISVEREKFHSN<br>NLPMFYKDADLKKILDLLYSDYAGRASQVPAFNTVLVRKNF<br>PEFLRKDMGYKVHFNNPEVENQWHSAVYYLYKEIYYNLFL<br>RDKEVKNLFYTSLKNIRSEVSDKKQKLASDDFASRCEEIEDR<br>SLPEICQIIMTEYNAQNFGNRKVKSQRVIEKNKDIFRHYKML<br>LIKTLAGAFSLYLKQERFAFIGKATPIPYETTDVKNFLPEWKS<br>GMYASFVEEIKNNLDLQEWYIVGRFLNGRMLNQLAGSLRSY<br>IQYAEDIERRAAENRNKLFSKPDEKIEACKKAVRVLDLCIKIS<br>TRISAEFTDYFDSEDDYADYLEKYLKYQDDAIKELSGSSYAA<br>LDHFCNKDDLKFDIYVNAGQKPILQRNIVMAKLFGPDNILSE<br>VMEKVTESAIREYYDYLKKVSGYRVRGKCSTEKEQEDLLKF<br>QRLKNAVEFRDVTEYAEVINELLGQLISWSYLRERDLLYFQL<br>GFHYMCLKNKSFKPAEYVDIRRNNGTIIHNAILYQIVSMYIN<br>GLDFYSCDKEGKTLKPIETGKGVGSKIGQFIKYSQYLYNDPS<br>YKLEIYNAGLEVFENIDEHDNITDLRKYVDHFKYYAYGNKM<br>SLLDLYSEFFDRFFTYDMKYQKNVVNVLENILLRHFVIFYPK<br>FGSGKKDVGIRDCKKERAQIEISEQSLTSEDFMFKLDDKAGE<br>EAKKFPARDERYLQTIAKLLYYPNEIEDMNRFMKKGETINK<br>KVQFNRKKKITRKQKNNSSNEVLSSTMGYLFKNIKL |
| C2-24 | Chloroflexus aggregans (SEQ ID NO: 89) | MTDQVRREEVAAGELADTPLAAAQTPAADAAVAATPAPAE<br>AVAPTPEQAVDQPATTGESEAPVTTAQAAAHEAEPAEATGA<br>SFTPVSEQQPQKPRRLKDLQPGMELEGKVTSIALYGIFVDVG<br>VGRDGLVHISEMSDRRIDTPSELVQIGDTVKVWVKSVDLDA<br>RRISLTMLNPSRGEKPRRSRQSQPAQPQPRRQEVDREKLASL<br>KVGEIVEGVITGFAPFGAFADIGVGKDGLIHISELSEGRVEKP<br>EDAVKVGERYQFKVLEIDGEGTRISLSLRRAQRTQRMQQLEP<br>GQIIEGTVSGIATFGAFVDIGVGRDGLVHISALAPHRVAKVED |

TABLE 2-continued

| | | |
|---|---|---|
| | | VVKVGDKVKVKVLGVDPQSKRISLTMRLEEEQPATTAGDEA AEPAEEVTPTRRGNLERFAAAAQTARERSERGERSERGERRE RRERRPAQSSPDTYIVGEDDDESFEGNATIEDLLTKFGGSSSR RDRDRRRRHEDDDDEEMERPSNRRQREAIRRTLQQIGYDE |
| C2-25 | Demequina aurantiaca (SEQ ID NO: 90) | MDLTWHALLILFIVALLAGELDTLAGGGGLLTVPALLLTGIP PLQALGTNKLQSSFGTGMATYQVIRKKRVHWRDVRWPMV WAFLGSAAGAVAVQFIDTDALLIIIPVVLALVAAYFLFVPKS HLPPPEPRMSDPAYEATLVPIIGAYDGAFGPGTGSLYALSGV ALRAKTLVQSTAIAKTLNFATNFAALLVFAFAGHMLWTVGA VMIAGQLIGAYAGSHMLFRVNPLVLRVLIVVMSLGMLIRVL LD |
| C2-26 | Thalassospira sp. TSL5-1 (SEQ ID NO: 91) | MRIIKPYGRSHVEGVATQEPRRKLRLNSSPDISRDIPGFAQSH DALIIAQWISAIDKIATKPKPDKKPTQAQINLRTTLGDAAWQ HVMAENLLPAATDPAIREKLHLIWQSKIAPWGTARPQAEKD GKPTPKGGWYERFCGVLSPEAITQNVARQIAKDIYDHLHVA AKRKGREPAKQGESSNKPGKFKPDRKRGLIEERAESIAKNAL RPGSHAPCPWGPDDQATYEQAGDVAGQIYAAARDCLEEKK RRSGNRNTSSVQYLPRDLAAKILYAQYGRVFGPDTTIKAALD EQPSLFALHKAIKDCYHRLINDARKRDILRILPRNMAALFRL VRAQYDNRDINALIRLGKVIHYHASEQGKSEHHGIRDYWPS QQDIQNSRFWGSDGQADIKRHEAFSRIWRHIIALASRTLHDW ADPHSQKFSGENDDILLLAKDAIEDDVFKAGHYERKCDVLF GAQASLFCGAEDFEKAILKQAITGTGNLRNATFHFKGKVRFE KELQELTKDVPVEVQSAIAALWQKDAEGRTRQIAETLQAVL AGHFLTEEQNRHIFAALTAAMAQPGDVPLPRLRRVLARHDSI CQRGRILPLSPCPDRAKLEESPALTCQYTVLKMLYDGPFRAW LAQQNSTILNHYIDSTIARTDKAARDMNGRKLAQAEKDLITS RAADLPRLSVDEKMGDFLARLTAATATEMRVQRGYQSDGE NAQKQAAFIGQFECDVIGRAFADFLNQSGFDFVLKLKADTP QPDAAQCDVTALIAPDDISVSPPQAWQQVLYFILHLVPVDDA SHLLHQIRKWQVLEGKEKPAQIAHDVQSVLMLYLDMHDAK FTGGAALHGIEKFAEFFAHAADFRAVFPPQSLQDQDRSIPRR GLREIVRFGHLPLLQHMSGTVQITHDNVVAWQAARTAGAT GMSPIARRQKQREELHALAVERTARFRNADLQNYMHALVD VIKHRQLSAQVTLSDQVRLHRLMMGVLGRLVDYAGLWERD LYFVVLALLYHHGATPDDVFKGQGKKNLADGQVVAALKPK NRKAAAPVGVFDDLDHYGIYQDDRQSIRNGLSHFNMLRGG KAPDLSHWVNQTRSLVAHDRKLKNAVAKSVIEMLAREGFD LDWGIQTDRGQHILSHGKIRTRQAQHFQKSRLHIVKKSAKPD KNDTVKIRENLHGDAMVERVVQLFAAQVQKRYDITVEKRL DHLFLKPQDQKGKNGIHTHNGWSKTEKKRRPSRENRKGNH EN |
| C2-27 | SAMN044 87830_13920 [Pseudobut yrivibrio sp. OR37] (SEQ ID NO: 92) | MKFSKESHRKTAVGVTESNGIIGLLYKDPLNEKEKIEDVVNQ RANSTKRLFNLFGTEATSKDISRASKDLAKVVNKAIGNLKGN KKFNKKEQITKGLNTKIIVEELKNVLKDEKKLIVNKDIIDEAC SRLLKTSFRTAKTKQAVKMILTAVLIENTNLSKEDEAFVHEY FVKKLVNEYNKTSVKKQIPVALSNQNMVIQPNSVNGTLEISE TKKSKETKTTEKDAFRAFLRDYATLDENRRHKMRLCLRNLV NLYFYGETSVSKDDFDEWRDHEDKKQNDELFVKKIVSIKTD RKGNVKEVLDVDATIDAIRTNNIACYRRALAYANENPDVFF SDTMLNKFWIHHVENEVERIYGHINNNTGDYKYQLGYLSEK VWKGIINYLSIKYIAEGKAVYNYAMNALAKDNNSNAFGKLD EKFVNGITSFEYERIKAEETLQRECAVNIAFAANHLANATVD LNEKDSDFLLLKHEDNKDTLGAVARPNILRNILQFFGGKSRW NDFDFSGIDEIQLLDDLRKMIYSLRNSSFHFKTENIDNDSWNT KLIGDMFAYDFNMAGNVQKDKMYSNNVPMFYSTSDIEKML DRLYAEVHERASQVPSFNSVFVRKNFPDYLKNDLKITSAFGV DDALKWQSAVYYVCKEIYYNDFLQNPETFTMLKDYVQCLPI DIDKSMDQKLKSERNAHKNFKEAFATYCKECDSLSAICQMI MTEYNNQNKGNRKVISARTKDGDKLIYKHYKMILFEALKN VFTIYLEKNINTYGFLKKPKLINNVPAIEEFLPNYNGRQYETL VNRITEETELQKWYIVGRLLNPKQVNQLIGNFRSYVQYVND VARRAKQTGNNLSNDNIAWDVKNIIQIFDVCTKLNGVTSNIL EDYFDDGDDYARYLKNFVDYTNKNNDHSATLLGDFCAKEI DGIKIGIYHDGTNPIVNRNIIQCKLYGATGIISDLTKDGSILSV DYEIIKKYMQMQKEIKVYQQKGICKTKEEQQNLKKYQELKN IVELRNIIDYSEILDELQGQLINWGYLRERDLMYFQLGFHYLC LHNESKKPVGYNNAGDISGAVLYQIVAMYTNGLSLIDANGK SKKNAKASAGAKVGSFCSYSKEIRGVDKDTKEDDDPIYLAG VELFENINEHQQCINLRNYIEHFHYYAKHDRSMLDLYSEVFD RFFTYDMKYTKNVPNMMYNILLQHLVVPAFEFGSSEKRLDD NDEQTKPRAMFTLREKNGLSSEQFTYRLGDGNSTVKLSARG DDYLRAVASLLYYPDRAPEGLIRDAEAEDKFAKINHSNPKSD NRNNRGNFKNPKVQWYNNKTKRK |

TABLE 2-continued

| | | |
|---|---|---|
| C2-28 | SAMN029 10398_00008 [Butyrivibrio sp. YAB3001] (SEQ ID NO: 93) | MKISKVDHRKTAVKITDNKGAEGFIYQDPTRDSSTMEQIISN<br>RARSSKVLFNIFGDTKKSKDLNKYTESLIIYVNKAIKSLKGDK<br>RNNKYEEITESLKTERVLNALIQAGNEFTCSENNIEDALNKY<br>LKKSFRVGNTKSALKKLLMAAYCGYKLSIEEKEEIQNYFVD<br>KLVKEYNKDTVLKYTAKSLKHQNMVVQPDTDNHVFLPSRI<br>AGATQNKMSEKEALTEFLKAYAVLDEEKRHNLRIILRKLVN<br>LYFYESPDFIYPENNEWKEHDDRKNKTETFVSPVKVNEEKN<br>GKTFVKIDVPATKDLIRLKNIECYRRSVAETAGNPITYFTDHN<br>ISKFWIHHIENEVEKIFALLKSNWKDYQFSVGYISEKVWKEII<br>NYLSIKYIAIGKAVYNYALEDIKKNDGTLNFGVIDPSFYDGIN<br>SFEYEKIKAEETFQREVAVYVSFAVNHLSSATVKLSEAQSDM<br>LVLNKNDIEKIAYGNTKRNILQFFGGQSKWKEFDFDRYINPV<br>NYTDIDFLFDIKKMVYSLRNESFHFTTTDTESDWNKNLISAM<br>FEYECRRISTVQKNKFFSNNLPLFYGENSLERVLHKLYDDYV<br>DRMSQVPSFGNVFVRKKFPDYMKEIGIKHNLSSEDNLKLQG<br>ALYFLYKEIYYNAFISSEKAMKIFVDLVNKLDTNARDDKGRI<br>THEAMAHKNFKDAISHYMTHDCSLADICQKIMTEYNQQNT<br>GHRKKQTTYSSEKNPEIFRHYKMILFMLLQKAMTEYISSEEIF<br>DFIMKPNSPKTDIKEEEFLPQYKSCAYDNLIKLIADNVELQK<br>WYITARLLSPREVNQLIGSFRSYKQFVSDIERRAKETNNSLSK<br>SGMTVDVENITKVLDLCTKLNGRFSNELTDYFDSKDDYAVY<br>VSKFLDFGFKIDEKFPAALLGEFCNKEENGKKIGIYHNGTEPI<br>LNSNIIKSKLYGITDVVSRAVKPVSEKLIREYLQQEVKIKPYL<br>ENGVCKNKEEQAALRKYQELKNRIEFRDIVEYSEIINELMGQ<br>LINFSYLRERDLMYFQLGFHYLCLNNYGAKPEGYYSIVNDK<br>RTIKGAILYQIVAMYTYGLPIYHYVDGTISDRRKNKKTVLDT<br>LNSSETVGAKIKYFIYYSDELFNDSLILYNAGLELFENINEHE<br>NIVNLRKYIDHFKYYVSQDRSLLDIYSEVFDRYFTYDRKYKK<br>NVMNLFSNIMLKHFIITDFEFSTGEKTIGEKNTAKKECAKVRI<br>KRGGLSSDKFTYKFKDAKPIELSAKNTEFLDGVARILYYPEN<br>VVLTDLVRNSEVEDEKRIEKYDRNHNSSPTRKDKTYKQDVK<br>KNYNKKTSKAFDSSKLDTKSVGNNLSDNPVLKQFLSESKKK<br>R |
| C2-29 | Blautia sp. Marseille-P2398 (SEQ ID NO: 94) | MKISKVDHVKSGIDQKLSSQRGMLYKQPQKKYEGKQLEEH<br>VRNLSRKAKALYQVFPVSGNSKMEKELQIINSFIKNILLRLDS<br>GKTSEEIVGYINTYSVASQISGDHIQELVDQHLKESLRKYTCV<br>GDKRIYVPDIIVALLKSKFNSETLQYDNSELKILIDFIREDYLK<br>EKQIKQIVHSIENNSTPLRIAEINGQKRLIPANVDNPKKSYIFE<br>FLKEYAQSDPKGQESLLQHMRYLILLYLYGPDKITDDYCEEI<br>EAWNFGSIVMDNEQLFSEEASMLIQDRIYVNQQIEEGRQSKD<br>TAKVKKNKSKYRMLGDKIEHSINESVVKHYQEACKAVEEK<br>DIPWIKYISDHVMSVYSSKNRVDLDKLSLPYLAKNTWNTWI<br>SFIAMKYVDMGKGVYHFAMSDVDKVGKQDNLIIGQIDPKFS<br>DGISSFDYERIKAEDDLHRSMSGYIAFAVNNFARAICSDEFRK<br>KNRKEDVLTVGLDEIPLYDNVKRKLLQYFGGASNWDDSIIDI<br>IDDKDLVACIKENLYVARNVNFHFAGSEKVQKKQDDILEEIV<br>RKETRDIGKHYRKVFYSNNVAVFYCDEDIIKLMNHLYQREK<br>PYQAQIPSYNKVISKTYLPDLIFMLLKGKNRTKISDPSIMNMF<br>RGTFYFLLKEIYYNDFLQASNLKEMFCEGLKNNVKNKKSEK<br>PYQNFMRRFEELENMGMDFGEICQQIMTDYEQQNKQKKKT<br>ATAVMSEKDKKIRTLDNDTQKYKHFRTLLYIGLREAFIIYLK<br>DEKNKEWYEFLREPVKREQPEEKEFVNKWKLNQYSDCSELI<br>LKDSLAAAWYVVAHFINQAQLNHLIGDIKNYIQFISDIDRRA<br>KSTGNPVSESTEIQIERYRKILRVLEFAKFFCGQITNVLTDYY<br>QDENDFSTHVGHYVKFEKKNMEPAHALQAFSNSLYACGKE<br>KKKAGFYYDGMNPIVNRNITLASMYGNKKLLENAMNPVTE<br>QDIRKYYSLMAELDSVLKNGAVCKSEDEQKNLRHFQNLKN<br>RIELVDVLTLSELVNDLVAQLIGWVYIRERDMMYLQLGLHY<br>IKLYFTDSVAEDSYLRTLDLEEGSIADGAVLYQIASLYSFNLP<br>MYVKPNKSSVYCKKHVNSVATKFDIFEKEYCNGDETVIENG<br>LRLFENINLHKDMVKFRDYLAHFKYFAKLDESILELYSKAYD<br>FFFSYNIKLKKSVSYVLTNVLLSYFINAKLSFSTYKSSGNKTV<br>QHRTTKISVVAQTDYFTYKLRSIVKNKNGVESIENDDRRCEV<br>VNIAARDKEFVDEVCNVINYNSDK |
| C2-30 | Leptotrichia sp. Marseille-P3007 (SEQ ID NO: 95) | MKITKIDGISHKKYIKEGKLVKSTSEENKTDERLSELLTIRLD<br>TYIKNPDNASEEENRIRRENLKEFFSNKVLYLKDGILYLKDR<br>REKNQLQNKNYSEEDISEYDLKNKNNFLVLKKILLNEDINSE<br>ELEIFRNDFEKKLDKINSLKYSLEENKANYQKINENNIKKVE<br>GKSKRNIFYNYYKDSAKRNDYINNIQEAFDKLYKKEDIENLF<br>FLIENSKKHEKYKIRECYHKIIGRKNDKENFATIIYEEIQNVNN<br>MKELIEKVPNVSELKKSQVFYKYYLNKEKLNDENIKYVFCH<br>FVEIEMSKLLKNYVYKKPSNISNDKVKRIFEYQSLKKLIENKL<br>LNKLDTYVRNCGKYSFYLQDGEIATSDFIVGNRQNEAFLRNI<br>IGVSSTAYFSLRNILETENENDITGRMRGKTVKNNKGEEKYIS<br>GEIDKLYDNNKQNEVKKNLKMFYSYDFNMNSKKEIEDFFSN<br>IDEAISSIRHGIVHFNLELEGKDIFTFKNIVPSQISKKMFHDEIN<br>EKKLKLKIFKQLNSANVFRYLEKYKILNYLNRTRFEFVNKNI<br>PFVPSFTKLYSRIDDLKNSLGIYWKTPKTNDDNKTKEITDAQI |

TABLE 2-continued

| | | |
|---|---|---|
| | | YLLKNIYYGEFLNYFMSNNGNFFEITKEIIELNKNDKRNLKT<br>GFYKLQKFENLQEKTPKEYLANIQSLYMINAGNQDEEEKDT<br>YIDFIQKIFLKGFMTYLANNGRLSLIYIGSDEETNTSLAEKKQ<br>EFDKFLKKYEQNNNIEIPYEINEFVREIKLGKILKYTERLNMF<br>YLILKLLNHKELTNLKGSLEKYQSANKEEAFSDQLELINLLN<br>LDNNRVTEDFELEADEIGKFLDFNGNKVKDNKELKKFDTNK<br>IYFDGENIIKHRAFYNIKKYGMLNLLEKISDEAKYKISIEELKN<br>YSKKKNEIEENHTTQENLHRKYARPRKDEKFTDEDYKKYEK<br>AIRNIQQYTHLKNKVEFNELNLLQSLLLRILHRLVGYTSIWER<br>DLRFRLKGEFPENQYIEEIFNFDNSKNVKYKNGQIVEKYINFY<br>KELYKDDTEKISIYSDKKVKELKKEKKDLYIRNYIAHFNYIPN<br>AEISLLEMLENLRKLLSYDRKLKNAIMKSIVDILKEYGFVVTF<br>KIEKDKKIRIESLKSEEVVHLKKLKLKDNDKKKEPIKTYRNS<br>KELCKLVKVMFEYKMKEKKSEN |
| C2-31 | Bacteroides ihuae(SEQ ID NO: 96) | MRITKVKVKESSDQKDKMVLIHRKVGEGTLVLDENLADLTA<br>PIIDKYKDKSFELSLLKQTLVSEKEMNIPKCDKCTAKERCLSC<br>KQREKRLKEVRGAIEKTIGAVIAGRDIIPRLNIFNEDEICWLIK<br>PKLRNEFTFKDVNKQVVKLNLPKVLVEYSKKNDPTLFLAYQ<br>QWIAAYLKNKKGHIKKSILNNRVVIDYSDESKLSKRKQALEL<br>WGEEYETNQRIALESYHTSYNIGELVTLLPNPEEYVSDKGEIR<br>PAFHYKLKNVLQMHQSTVFGTNEILCINPIFNENRANIQLSAY<br>NLEVVKYFEHYFPIKKKKKNLSLNQAIYYLKVETLKERLSLQ<br>LENALRMNLLQKGKIKKHEFDKNTCSNTLSQIKRDEFFVLNL<br>VEMCAFAANNIRNIVDKEQVNEILSKKDLCNSLSKNTIDKEL<br>CTKFYGADFSQIPVAIWAMRGSVQQIRNEIVHYKAEAIDKIF<br>ALKTFEYDDMEKDYSDTPFKQYLELSIEKIDSFFIEQLSSNDV<br>LNYYCTEDVNKLLNKCKLSLRRTSIPFAPGFKTIYELGCHLQ<br>DSSNTYRIGHYLMLIGGRVANSTVTKASKAYPAYRFMLKLI<br>YNHLFLNKFLDNHNKRFFMKAVAFVLKDNRENARNKFQYA<br>FKEIRMMNNDESIASYMSYIHSLSVQEQEKKGDKNDKVRYN<br>TEKFIEKVFVKGFDDFLSWLGVEFILSPNQEERDKTVTREEYE<br>NLMIKDRVEHSINSNQESHIAFFTFCKLLDANHLSDLRNEWI<br>KFRSSGDKEGFSYNFAIDIIELCLLTVDRVEQRRDGYKEQTEL<br>KEYLSFFIKGNESENTVWKGFYFQQDNYTPVLYSPIELIRKY<br>GTLELLKLIIVDEDKITQGEFEEWQTLKKVVEDKVTRRNELH<br>QEWEDMKNKSSFSQEKCSIYQKLCRDIDRYNWLDNKLHLV<br>HLRKLHNLVIQILSRMARFIALWDRDFVLLDASRANDDYKL<br>LSFFNFRDFINAKKTKTDDELLAEFGSKIEKKNAPFIKAEDVP<br>LMVECIEAKRSFYQKVFFRNNLQVLADRNFIAHYNYISKTAK<br>CSLFEMIIKLRTLMYYDRKLRNAVVKSIANVFDQNGMVLQL<br>SLDDSHELKVDKVISKRIVHLKNNNIMTDQVPEEYYKICRRL<br>LEMKK |
| C2-32 | SAMN052 16357_1045 [Porphyro monadaceae bacterium KH3CP3RA] (SEQ ID NO: 97) | MEFRDSIFKSLLQKEIEKAPLCFAEKLISGGVFSYYPSERLKEF<br>VGNHPFSLFRKTMPFSPGFKRVMKSGGNYQNANRDGRFYD<br>LDIGVYLPKDGFGDEEWNARYFLMKLIYNQLFLPYFADAEN<br>HLFRECVDFVKRVNRDYNCKNNNSEEQAFIDIRSMREDESIA<br>DYLAFIQSNIIIEENKKKETNKEGQINFNKFLLQVFVKGFDSFL<br>KDRTELNFLQLPELQGDGTRGDDLESLDKLGAVVAVDLKLD<br>ATGIDADLNENISFYTFCKLLDSNHLSRLRNEIIKYQSANSDF<br>SHNEDFDYDRIISIIELCMLSADHVSTNDNESIFPNNDKDFSGI<br>RPYLSTDAKVETFEDLYVHSDAKTPITNATMVLNWKYGTDK<br>LFERLMISDQDFLVTEKDYFVWKELKKDIEEKIKLREELHSL<br>WVNTPKGKKGAKKKNGRETTGEFSEENKKEYLEVCREIDRY<br>VNLDNKLHFVHLKRMHSLLIELLGRFVGFTYLFERDYQYYH<br>LEIRSRRNKDAGVVDKLEYNKIKDQNKYDKDDFFACTFLYE<br>KANKVRNFIAHFNYLTMWNSPQEEEHNSNLSGAKNSSGRQN<br>LKCSLTELINELREVMSYDRKLKNAVTKAVIDLFDKHGMVI<br>KFRIVNNNNNDNKNKHHLELDDIVPKKIMHLRGIKLKRQDG<br>KPIPIQTDSVDPLYCRMWKKLLDLKPTPF |
| C2-33 | Listeria riparia (SEQ ID NO: 98) | MHDAWAENPKKPQSDAFLKEYKACCEAIDTYNWHKNKAT<br>LVYVNELHHLLIDILGRLVGYVAIADRDFQCMANQYLKSSG<br>HTERVDSWINTIRKNRPDYIEKLDIFMNKAGLFVSEKNGRNY<br>IAHLNYLSPKHKYSLLYLFEKLREMLKYDRKLKNAVTKSLID<br>LLDKHGMCVVFANLKNNKHRLVIASLKPKKIETFKWKKIK |
| C2-34 | Insolitispirillum peregrinum (SEQ ID NO: 99) | MRIIRPYGSSTVASPSPQDAQPLRSLQRQNGTFDVAEFSRRHP<br>ELVLAQWVAMLDKIIRKPAPGKNSTALPRPTAEQRRLRQQV<br>GAALWAEMQRHTPVPPELKAVWDSKVHPYSKDNAPATAKT<br>PSHRGRWYDRFGDPETSAATVAEGVRRHLLDSAQPFRANGG<br>QPKGKGVIEHRALTIQNGTLLHHHQSEKAGPLPEDWSTYRA<br>DELVSTIGKDARWIKVAASLYQHYGRIFGPTTPISEAQTRPEF<br>VLHTAVKAYYRRLFKERKLPAERLERLLPRTGEALRHAVTV<br>QHGNRSLADAVRIGKILHYGWLQNGEPDPWPDDAALYSSR<br>YWGSDGQTDIKHSEAVSRVWRRALTAAQRTLTSWLYPAGT<br>DAGDILLIGQKPDSIDRNRLPLLYGDSTRHWTRSPGDVWLFL<br>KQTLENLRNSSFHFKTLSAFTSHLDGTCESEPAEQQAAQALW<br>QDDRQQDHQQVFLSLRALDATTYLPTGPLHRIVNAVQSTDA |

TABLE 2-continued

| | | |
|---|---|---|
| | | TLPLPRFRRVVTRAANTRLKGFPVEPVNRRTMEDDPLLRCR<br>YGVLKLLYERGFRAWLETRPSIASCLDQSLKRSTKAAQTING<br>KNSPQGVEILSRATKLLQAEGGGGHGIHDLFDRLYAATARE<br>MRVQVGYHHDAEAARQQAEFIEDLKCEVVARAFCAYLKTL<br>GIQGDTFRRQPEPLPTWPDLPDLPSSTIGTAQAALYSVLHLMP<br>VEDVGSLLHQLRRWLVALQARGGEDGTAITATIPLLELYLN<br>RHDAKFSGGGAGTGLRWDDWQVFFDCQATFDRVFPPGPAL<br>DSHRLPLRGLREVLRFGRVNDLAALIGQDKITAAEVDRWHT<br>AEQTIAAQQQRREALHEQLSRKKGTDAEVDEYRALVTAIAD<br>HRHLTAHVILSNVVRLHRLMTTVLGRLVDYGGLWERDLTF<br>VTLYEAHRLGGLRNLLSESRVNKFLDGQTPAALSKKNNAEE<br>NGMISKVLGDKARRQIRNDFAHFNMLQQGKKTINLTDEINN<br>ARKLMAHDRKLKNAITRSVTTLLQQDGLDIVWTMDASHRL<br>TDAKIDSRNAIHLHKTHNRANIREPLHGKSYCRWVAALFGA<br>TSTPSATKKSDKIR |

In certain example embodiments, the CRISPR effector protein is a Cas13b protein selected from Table 2.

TABLE 3

| | | |
|---|---|---|
| *Bergeyella zoohelcum* | 1 (SEQ ID NO: 100) | MENKTSLGNNIYYNPFKPQDKSYFAGYFNAAMENTDSVFRELG<br>KRLKGKEYTSENFFDAIFKENISLVEYERYVKLLSDYFPMARLL<br>DKKEVPIKERKENFKKNFKGIIKAVRDLRNFYTHKEHGEVEITD<br>EIFGVLDEMLKSTVLTVKKKKVKTDKTKEILKKSIEKQLDILCQ<br>KKLEYLRDTARKIEEKRRNQRERGEKELVAPFKYSDKRDDLIA<br>AIYNDAFDVYIDKKKDSLKESSKAKYNTKSDPQQEEGDLKIPIS<br>KNGVVFLLSLFLTKQEIHAFKSKIAGFKATVIDEATVSEATVSHG<br>KNSICFMATHEIFSHLAYKKLKRKVRTAEINYGEAENAEQLSVY<br>AKETLMMQMLDELSKVPDVVYQNLSEDVQKTFIEDWNEYLKE<br>NNGDVGTMEEEQVIHPVIRKRYEDKFNYFAIRFLDEFAQFPTLR<br>FQVHLGNYLHDSRPKENLISDRRIKEKITVFGRLSELEHKKALFI<br>KNTETNEDREHYWEIFPNPNYDFPKENISVNDKDFPIAGSILDRE<br>KQPVAGKIGIKVKLLNQQYVSEVDKAVKAHQLKQRKASKPSIQ<br>NIIEEIVPINESNPKEAIVFGGQPTAYLSMNDIHSILYEFFDKWEK<br>KKEKLEKKGEKELRKEIGKELEKKIVGKIQAQIQQIIDKDTNAKI<br>LKPYQDGNSTAIDKEKLIKDLKQEQNILQKLKDEQTVREKEYN<br>DFIAYQDKNREINKVRDRNHKQYLKDNLKRKYPEAPARKEVL<br>YYREKGKVAVWLANDIKRFMPTDFKNEWKGEQHSLLQKSLAY<br>YEQCKEELKNLLPEKVFQHLPFKLGGYFQQKYLYQFYTCYLDK<br>RLEYISGLVQQAENFKSENKVFKKVENECFKFLKKQNYTHKEL<br>DARVQSILGYPIFLERGFMDEKPTIIKGKTFKGNEALFADWFRY<br>YKEYQNFQTFYDTENYPLVELEKKQADRKRKTKIYQQKKNDV<br>FTLLMAKHIFKSVFKQDSIDQFSLEDLYQSREERLGNQERARQT<br>GERNTNYIWNKTVDLKLCDGKITVENVKLKNVGDFIKYEYDQR<br>VQAFLKYEENIEWQAFLIKESKEEENYPYVVEREIEQYEKVRRE<br>ELLKEVHLIEEYILEKVKDKEILKKGDNQNFKYYILNGLLKQLK<br>NEDVESYKVFNLNTEPEDVNINQLKQEATDLEQKAFVLTYIRN<br>KFAHNQLPKKEFWDYCQEKYGKIEKEKTYAEYFAEVFKKEKE<br>ALIK |
| *Prevotella intermedia* | 2 (SEQ ID NO: 101) | MEDDKKTTDSIRYELKDKHFWAAFLNLARHNVYITVNHINKIL<br>EEGEINRDGYETTLKNTWNEIKDINKKDRLSKLIIKHFPFLEAAT<br>YRLNPTDTTKQKEEKQAEAQSLESLRKSFFVFIYKLRDLRNHYS<br>HYKHSKSLERPKFEEGLLEKMYNIFNASIRLVKEDYQYNKDINP<br>DEDFKHLDRTEEEFNYYFTKDNEGNITESGLLFFVSLFLEKKDAI<br>WMQQKLRGFKDNRENKKKMTNEVFCRSRMLLPKLRLQSTQTQ<br>DWILLDMLNELIRCPKSLYERLREEDREKFRVPIEIADEDYDAEQ<br>EPFKNTLVRHQDRFPYFALRYFDYNEIFTNLRFQIDLGTYHFSIY<br>KKQIGDYKESHHLTHKLYGFERIQEFTKQNRPDEWRKFVKTFN<br>SFETSKEPYIPETTPHYHLENQKIGIRFRNDNDKIWPSLKTNSEK<br>NEKSKYKLDKSFQAEAFLSVHELLPMMFYYLLLKTENTDNDNE<br>IETKKKENKNDKQEKHKIEEIIENKITEIYALYDTFANGEIKSIDE<br>LEEYCKGKDIEIGHLPKQMIAILKDEHKVMATEAERKQEEMLV<br>DVQKSLESLDNQINEEIENVERKNSSLKSGKIASWLVNDMMRF<br>QPVQKDNEGKPLNNSKANSTEYQLLQRTLAFFGSEHERLAPYF<br>KQTKLIESSNPHPFLKDTEWEKCNNILSFYRSYLEAKKNFLESLK<br>PEDWEKNQYFLKLKEPKTKPKTLVQGWKNGFNLPRGIFTEPIRK<br>WFMKHRENITVAELKRVGLVAKVIPLFFSEEYKDSVQPFYNYH<br>FNVGNINKPDEKNFLNCEERRELLRKKKDEFKKMTDKEKEENP<br>SYLEFKSWNKFERELRLVRNQDIVTWLLCMELFNKKKIKELNV<br>EKIYLKNINTNTTKKEKNTEEKNGEEKNIKEKNNILNRIMPMRL<br>PIKVYGRENFSKNKKKKIRRNTFFTVYIEEKGTKLLKQGNFKAL<br>ERDRRLGGLFSFVKTPSKAESKSNTISKLRVEYELGEYQKARIEII<br>KDMLALEKTLIDKYNSLDTDNFNKMLTDWLELKGEPDKASFQ<br>NDVDLLIAVRNAFSHNQYPMRNRIAFANINPFSLSSANTSEEKG<br>LGIANQLKDKTHKTIEKIIEIEKPIETKE |

TABLE 3-continued

| | | |
|---|---|---|
| *Prevotella buccae* | 3 (SEQ ID NO: 102) | MQKQDKLFVDRKKNAIFAFPKYITIMENKEKPEPIYYELTDKHF<br>WAAFLNLARHNVYTTINHINRRLEIAELKDDGYMMGIKGSWNE<br>QAKKLDKKVRLRDLIMKHFPFLEAAAYEMTNSKSPNNKEQRE<br>KEQSEALSLNNLKNVLFIFLEKLQVLRNYYSHYKYSEESPKPIFE<br>TSLLKNMYKVFDANVRLVKRDYMHHENIDMQRDFTHLNRKK<br>QVGRTKNIIDSPNFHYHFADKEGNMTIAGLLFFVSLFLDKKDAI<br>WMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYHFS<br>IYNKRIGDEDEVRHLTHHLYGFARIQDFAPQNQPEEWRKLVKD<br>LDHFETSQEPYISKTAPHYHLENEKIGIKFCSAHNNLFPSLQTDK<br>TCNGRSKFNLGTQFTAEAFLSVHELLPMMFYYLLLTKDYSRKE<br>SADKVEGIIRKEISNIYAIYDAFANNEINSIADLTRRLQNTNILQG<br>HLPKQMISILKGRQKDMGKEAERKIGEMIDDTQRRLDLLCKQT<br>NQKIRIGKRNAGLLKSGKIADWLVNDMMRFQPVQKDQNNIPIN<br>NSKANSTEYRMLQRALALFGSENFRLKAYFNQMNLVGNDNPH<br>PFLAETQWEHQTNILSFYRNYLEARKKYLKGLKPQNWKQYQH<br>FLILKVQKTNRNTLVTGWKNSFNLPRGIFTQPIREWFEKHNNSK<br>RIYDQILSFDRVGFVAKAIPLYFAEEYKDNVQPFYDYPFNIGNRL<br>KPKKRQFLDKKERVELWQKNKELFKNYPSEKKKTDLAYLDFLS<br>WKKFERELRLIKNQDIVTWLMFKELFNMATVEGLKIGEIHLRDI<br>DTNTANEESNNILNRIMPMKLPVKTYETDNKGNILKERPLATFY<br>IEETETKVLKQGNFKALVKDRRLNGLFSFAETTDLNLEEHPISKL<br>SVDLELIKYQTTRISIFEMTLGLEKKLIDKYSTLPTDSFRNMLER<br>WLQCKANRPELKNYVNSLIAVRNAFSHNQYPMYDATLFAEVK<br>KFTLFPSVDTKKIELNIAPQLLEIVGKAIKEIEKSENKN |
| *Porphyromonas gingivalis* | 4 (SEQ ID NO: 103) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFAVFFKPDDFVLA<br>KNRKEQLISVADGKECLTVSGFAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLDEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELRLLDPSSGHPFLSATMETAHRYTEGFYKCYLEKKREWLAK<br>IFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIHGKSVSYIPSDGKKFADCYTHL<br>MEKTVRDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| *Bacteroides pyogenes* | 5 (SEQ ID NO: 104) | MESIKNSQKSTGKTLQKDPPYFGLYLNMALLNVRKVENHIRKW<br>LGDVALLPEKSGFHSLLTTDNLSSAKWTRFYYKSRKFLPFLEMF<br>DSDKKSYENRRETAECLDTIDRQKISSLLKEVYGKLQDIRNAFS<br>HYHIDDQSVKHTALIISSEMHRFIENAYSFALQKTRARFTGVFVE<br>TDFLQAEEKGDNKKFFAIGGNEGIKLKDNALIFLICLFLDREEAF<br>KFLSRATGFKSTKEKGFLAVRETFCALCCRQPHERLLSVNPREA<br>LLMDMLNELNRCPDILFEMLDEKDQKSFLPLLGEEEQAHILENS<br>LNDELCEAIDDPFEMIASLSKRVRYKNRFPYLMLRYIEEKNLLPF<br>IRFRIDLGCLELASYPKKMGEENNYERSVTDHAMAFGRLTDFH<br>NEDAVLQQITKGITDEVRFSLYAPRYAIYNNKIGFVRTSGSDKIS<br>FPTLKKKGGEGHCVAYTLQNTKSFGFISIYDLRKILLLSFLDKDK<br>AKNIVSGLLEQCEKHWKDLSENLFDAIRTELQKEFPVPLIRYTLP<br>RSKGGKLVSSKLADKQEKYESEFERRKEKLTEILSEKDFDLSQIP<br>RRMIDEWLNVLPTSREKKLKGYVETLKLDCRERLRVFEKREKG<br>EHPLPPRIGEMATDLAKDIIRMVIDQGVKQRITSAYYSEIQRCLA<br>QYAGDDNRRHLDSIIRELRLKDTKNGHPFLGKVLRPGLGHTEK<br>LYQRYFEEKKEWLEATFYPAASPKRVPRFVNPPTGKQKELPLII<br>RNLMKERPEWRDWKQRKNSHPIDLPSQLFENEICRLLKDKIGKE<br>PSGKLKWNEMFKLYWDKEFPNGMQRFYRCKRRVEVFDKVVE<br>YEYSEEGGNYKKYYEALIDEVVRQKISSSKEKSKLQVEDLTLSV<br>RRVFKRAINEKEYQLRLLCEDDRLLFMAVRDLYDWKEAQLDL<br>DKIDNMLGEPVSVSQVIQLEGGQPDAVIKAECKLKDVSKLMRY |

TABLE 3-continued

| | | |
|---|---|---|
| | | CYDGRVKGLMPYFANHEATQEQVEMELRHYEDHRRRVFNWV FALEKSVLKNEKLRRFYEESQGGCEHRRCIDALRKASLVSEEEY EFLVHIRNKSAHNQFPDLEIGKLPPNVTSGFCECIWSKYKAIICRI IPFIDPERRFFGKLLEQK |
| *Alistipes* sp. ZOR0009 | 6 (SEQ ID NO: 105) | MSNEIGAFREHQFAYAPGNEKQEEATFATYFNLALSNVEGMMF GEVESNPDKIEKSLDTLPPAILRQIASFIWLSKEDHPDKAYSTEE VKVIVTDLVRRLCFYRNYFSHCFYLDTQYFYSDELVDTTAIGEK LPYNFHHFITNRLFRYSLPEITLFRWNEGERKYEILRDGLIFFCCL FLKRGQAERFLNELRFFKRTDEEGRIKRTIFTKYCTRESHKHIGIE EQDFLIFQDIIGDLNRVPKVCDGVVDLSKENERYIKNRETSNESD ENKARYRLLIREKDKFPYYLMRYIVDFGVLPCITFKQNDYSTKE GRGQFHYQDAAVAQEERCYNFVVRNGNVYYSYMPQAQNVVR ISELQGTISVEELRNMVYASINGKDVNKSVEQYLYHLHLLYEKI LTISGQTIKEGRVDVEDYRPLLDKLLLRPASNGEELRRELRKLLP KRVCDLLSNRFDCSEGVSAVEKRLKAILLRHEQLLLSQNPALHI DKIKSVIDYLYLFFSDDEKFRQQPTEKAHRGLKDEEFQMYHYL VGDYDSHPLALWKELEASGRLKPEMRKLTSATSLHGLYMLCL KGTVEWCRKQLMSIGKGTAKVEAIADRVGLKLYDKLKEYTPE QLEREVKLVVMHGYAAAATPKPKAQAAIPSKLTELRFYSFLGK REMSFAAFIRQDKKAQKLWLRNFYTVENIKTLQKRQAAADAA CKKLYNLVGEVERVHTNDKVLVLVAQRYRERLLNVGSKCAVT LDNPERQQKLADVYEVQNAWLSIRFDDLDFTLTHVNLSNLRKA YNLIPRKHILAFKEYLDNRVKQKLCEECRNVRRKEDLCTCCSPR YSNLTSWLKENHSESSIEREAATMMLLDVERKLLSFLLDERRKA IIEYGKFIPFSALVKECRLADAGLCGIRNDVLHDNVISYADAIGK LSAYFPKEASEAVEYIRRTKEVREQRREELMANSSQ |
| *Prevotella* sp. MA2016 | 7a (SEQ ID NO: 106) | MSKECKKQRQEKKRRLQKANFSISLTGKHVFGAYFNMARTNF VKTINYILPIAGVRGNYSENQINKMLHALFLIQAGRNEELTTEQK QWEKKLRLNPEQQTKFQKLLFKHFPVLGPMMADVADHKAYL NKKKSTVQTEDETFAMLKGVSLADCLDIICLMADTLTECRNFY THKDPYNKPSQLADQYLHQEMIAKKLDKVVVASRRILKDREGL SVNEVEFLTGIDHLHQEVLKDEFGNAKVKDGKVMKTFVEYDD FYFKISGKRLVNGYTVTTKDDKPVNVNTMLPALSDFGLLYFCV LFLSKPYAKLFIDEVRLFEYSPFDDKENMIMSEMLSIYRIRTPRL HKIDSHDSKATLAMDIFGELRRCPMELYNLLDKNAGQPFFHDE VKHPNSHTPDVSKRLRYDDRFPTLALRYIDETELFKRIRFQLQL GSFRYKFYDKENCIDGRVRVRRIQKEINGYGRMQEVADKRMD KWGDLIQKREERSVKLEHEELYINLDQFLEDTADSTPYVTDRRP AYNIHANRIGLYWEDSQNPKQYKVFDENGMYIPELVVTEDKKA PIKMPAPRCALSVYDLPAMLFYEYLREQQDNEFPSAEQVIIEYE DDYRKFFKAVAEGKLKPFKRPKEFRDFLKKEYPKLRMADIPKK LQLFLCSHGLCYNNKPETVYERLDRLTLQHLEERELHIQNRLEH YQKDRDMIGNKDNQYGKKSFSDVRHGALARYLAQSMMEWQP TKLKDKEKGHDKLTGLNYNVLTAYLATYGHPQVPEEGFTPRTL EQVLINAHLIGGSNPHPFINKVLALGNRNIEELYLHYLEEELKHI RSRIQSLSSNPSDKALSALPFIHHDRMRYHERTSEEMMALAARY TTIQLPDGLFTPYILEILQKHYTENSDLQNALSQDVPVKLNPTCN AAYLITLFYQTVLKDNAQPFYLSDKTYTRNKDGEKAESFSFKR AYELFSVLNNNKKDTFPFEMIPLFLTSDEIQERLSAKLLDGDGNP VPEVGEKGKPATDSQGNTIWKRRIYSEVDDYAEKLTDRDMKIS FKGEWEKLPRWKQDKIIKRRDETRRQMRDELLQRMPRYIRDIK DNERTLRRYKTQDMVLFLLAEKMFTNIISEQSSEFNWKQMRLS KVCNEAFLRQTLTFRVPVTVGETTIYVEQENMSLKNYGEFYRFL TDDRLMSLLNNIVETLKPNENGDLVIRHTDLMSELAAYDQYRS TIFMLIQSIENLIITNNAVLDDPDADGFWVREDLPKRNNFASLLE LINQLNNVELTDDERKLLVAIRNAFSHNSYNIDFSLIKDVKHLPE VAKGILQHLQSMLGVEITK |
| *Prevotella* sp. MA2016 | 7b (SEQ ID NO: 107) | MSKECKKQRQEKKRRLQKANFSISLTGKHVFGAYFNMARTNF VKTINYILPIAGVRGNYSENQINKMLHALFLIQAGRNEELTTEQK QWEKKLRLNPEQQTKFQKLLFKHFPVLGPMMADVADHKAYL NKKKSTVQTEDETFAMLKGVSLADCLDIICLMADTLTECRNFY THKDPYNKPSQLADQYLHQEMIAKKLDKVVVASRRILKDREGL SVNEVEFLTGIDHLHQEVLKDEFGNAKVKDGKVMKTFVEYDD FYFKISGKRLVNGYTVTTKDDKPVNVNTMLPALSDFGLLYFCV LFLSKPYAKLFIDEVRLFEYSPFDDKENMIMSEMLSIYRIRTPRL HKIDSHDSKATLAMDIFGELRRCPMELYNLLDKNAGQPFFHDE VKHPNSHTPDVSKRLRYDDRFPTLALRYIDETELFKRIRFQLQL GSFRYKFYDKENCIDGRVRVRRIQKEINGYGRMQEVADKRMD KWGDLIQKREERSVKLEHEELYINLDQFLEDTADSTPYVTDRRP AYNIHANRIGLYWEDSQNPKQYKVFDENGMYIPELVVTEDKKA PIKMPAPRCALSVYDLPAMLFYEYLREQQDNEFPSAEQVIIEYE DDYRKFFKAVAEGKLKPFKRPKEFRDFLKKEYPKLRMADIPKK LQLFLCSHGLCYNNKPETVYERLDRLTLQHLEERELHIQNRLEH YQKDRDMIGNKDNQYGKKSFSDVRHGALARYLAQSMMEWQP TKLKDKEKGHDKLTGLNYNVLTAYLATYGHPQVPEEGFTPRTL EQVLINAHLIGGSNPHPFINKVLALGNRNIEELYLHYLEEELKHI RSRIQSLSSNPSDKALSALPFIHHDRMRYHERTSEEMMALAARY |

TABLE 3-continued

| | | |
|---|---|---|
| | | TTIQLPDGLFTPYILEILQKHYTENSDLQNALSQDVPVKLNPTCN<br>AAYLITLFYQTVLKDNAQPFYLSDKTYTRNKDGEKAESFSFKR<br>AYELFSVLNNNKKDTFPFEMIPLFLTSDEIQERLSAKLLDGDGNP<br>VPEVGEKGKPATDSQGNTIWKRRIYSEVDDYAEKLTDRDMKIS<br>FKGEWEKLPRWKQDKIIKRRDETRRQMRDELLQRMPRYIRDIK<br>DNERTLRRYKTQDMVLFLLAEKMFTNIISEQSSEFNWKQMRLS<br>KVCNEAFLRQTLTFRVPVTVGETTIYVEQENMSLKNYGEFYRFL<br>TDDRLMSLLNNIVETLKPNENGDLVIRHTDLMSELAAYDQYRS<br>TIFMLIQSIENLIITNNAVLDDPDADGFWVREDLPKRNNFASLLE<br>LINQLNNVELTDDERKLLVAIRNAFSHNSYNIDFSLIKDVKHLPE<br>VAKGILQHLQSMLGVEITK |
| *Riemerella anatipestifer* | 8 (SEQ ID NO: 108) | MEKPLLPNVYTLKHKFFWGAFLNIARHNAFITICHINEQLGLKT<br>PSNDDKIVDVVCETWNNILNNDHDLLKKSQLTELILKHFPFLTA<br>MCYHPPKKEGKKKGHQKEQQKEKESEAQSQAEALNPSKLIEAL<br>EILVNQLHSLRNYYSHYKHKKPDAEKDIFKHLYKAFDASLRMV<br>KEDYKAHFTVNLTRDFAHLNRKGKNKQDNPDFNRYRFEKDGF<br>FTESGLLFFTNLFLDKRDAYWMLKKVSGFKASHKQREKMTTE<br>VFCRSRILLPKLRLESRYDHNQMLLDMLSELSRCPKLLYEKLSE<br>ENKKHFQVEADGFLDEIEEEQNPFKDTLIRHQDRFPYFALRYLD<br>LNESFKSIRFQVDLGTYHYCIYDKKIGDEQEKRHLTRTLLSFGRL<br>QDFTEINRPQEWKALTKDLDYKETSNQPFISKTTPHYHITDNKIG<br>FRLGTSKELYPSLEIKDGANRIAKYPYNSGFVAHAFISVHELLPL<br>MFYQHLTGKSEDLLKETVRHIQRIYKDFEEERINTIEDLEKANQ<br>GRLPLGAFPKQMLGLLQNKQPDLSEKAKIKIEKLIAETKLLSHR<br>LNTKLKSSPKLGKRREKLIKTGVLADWLVKDFMRFQPVAYDA<br>QNQPIKSSKANSTEFWFIRRALALYGGEKNRLEGYFKQTNLIGN<br>TNPHPFLNKFNWKACRNLVDFYQQYLEQREKFLEAIKNQPWEP<br>YQYCLLLKIPKENRKNLVKGWEQGGISLPRGLFTEAIRETLSED<br>LMLSKPIRKEIKKHGRVGFISRAITLYFKEKYQDKHQSFYNLSY<br>KLEAKAPLLKREEHYEYWQQNKPQSPTESQRLELHTSDRWKD<br>YLLYKRWQHLEKKLRLYRNQDVMLWLMTLELTKNHFKELNL<br>NYHQLKLENLAVNVQEADAKLNPLNQTLPMVLPVKVYPATAF<br>GEVQYHKTPIRTVYIREEHTKALKMGNFKALVKDRRLNGLFSFI<br>KEENDTQKHPISQLRLRRELEIYQSLRVDAFKETLSLEEKLLNKH<br>TSLSSLENEFRALLEEWKKEYAASSMVTDEHIAFIASVRNAFCH<br>NQYPFYKEALHAPIPLFTVAQPTTEEKDGLGIAEALLKVLREYC<br>EIVKSQI |
| *Prevotella aurantiaca* | 9 (SEQ ID NO: 109) | MEDDKKTTGSISYELKDKHFWAAFLNLARHNVYITINHINKLLE<br>IREIDNDEKVLDIKTLWQKGNKDLNQKARLRELMTKHFPFLET<br>AIYTKNKEDKKEVKQEKQAEAQSLESLKDCLFLFLDKLQEARN<br>YYSHYKYSEFSKEPEFEEGLLEKMYNIFGNNIQLVINDYQHNKD<br>INPDEDFKHLDRKGQFKYSFADNEGNITESGLLFFVSLFLEKKD<br>AIWMQQKLNGFKDNLENKKKMTHEVFCRSRILMPKLRLESTQT<br>QDWILLDMLNELIRCPKSLYERLQGDDREKFKVPFDPADEDYN<br>AEQEPFKNTLIRHQDRFPYFVLRYFDYNEIFKNLRFQIDLGTYHF<br>SIYKKLIGGQKEDRHLTHKLYGFERIQEFAKQNRPDEWKAIVKD<br>LDTYETSNKRYISETTPHYHLENQKIGIRFRNGNKEIWPSLKTND<br>ENNEKSKYKLDKQYQAEAFLSVHELLPMMFYYLLLKKEKPNN<br>DEINASIVEGFIKREIRNIFKLYDAFANGEINNIDDLEKYCADKGI<br>PKRHLPKQMVAILYDEHKDMVKEAKRKQKEMVKDTKKLLAT<br>LEKQTQKEKEDDGRNVKLLKSGEIARWLVNDMMRFQPVQKD<br>NEGKPLNNSKANSTEYQMLQRSLALYNNEEKPTRYFRQVNLIE<br>SNNPHPFLKWTKWEECNNILTFYYSYLTKKIEFLNKLKPEDWK<br>KNQYFLKLKEPKTNRETLVQGWKNGFNLPRGIFTEPIREWFKR<br>HQNNSKEYEKVEALDRVGLVTKVIPLFFKEEYFKDKEENFKED<br>TQKEINDCVQPFYNFPYNVGNIHKPKEKDFLHREERIELWDKKK<br>DKFKGYKEKIKSKKLTEKDKEEFRSYLEFQSWNKFERELRLVR<br>NQDIVTWLLCKELIDKLKIDELNIEELKKLRLNNIDTDTAKKEK<br>NNILNRVMPMELPVTVYEIDDSHKIVKDKPLHTIYIKEAETKLL<br>KQGNFKALVKDRRLNGLFSFVKTNSEAESKRNPISKLRVEYELG<br>EYQEARIEIIQDMLALEEKLINKYKDLPTNKFSEMLNSWLEGKD<br>EADKARFQNDVDFLIAVRNAFSHNQYPMHNKIEFANIKPFSLYT<br>ANNSEEKGLGIANQLKDKTKETTDKIKKIEKPIETKE |
| *Prevotella saccharolytica* | 10 (SEQ ID NO: 110) | MEDKPFWAAFFNLARHNVYLTVNHINKLLDLEKLYDEGKHKEI<br>FEREDIFNISDDVMNDANSNGKKRKLDIKKIWDDLDTDLTRKY<br>QLRELILKHFPFIQPAIIGAQTKERTTIDKDKRSTSTSNDSLKQTG<br>EGDINDLLSLSNVKSMFFRLLQILEQLRNYYSHVKHSKSATMPN<br>FDEDLLNWMRYIFIDSVNKVKEDYSSNSVIDPNTSFSHLIYKDE<br>QGKIKPCRYPFTSKDGSINAFGLLFFVSLFLEKQDSIWMQKKIPG<br>FKKASENYMKMTNEVFCRNHILLPKIRLETVYDKDWMLLDML<br>NEVVRCPLSLYKRLTPAAQNKFKVPEKSSDNANRQEDDNPFSRI<br>LVRHQNRFPYFVLRFFDLNEVFTTLRFQINLGCYHFAICKKQIGD<br>KKEVHHLIRTLYGFSRLQNFTQNTRPEEWNTLVKTTEPSSGNDG<br>KTVQGVPLPYISYTIPHYQIENEKIGIKIFDGDTAVDTDIWPSVST<br>EKQLNKPDKYTLTPGFKADVFLSVHELLPMMFYYQLLLCEGML<br>KTDAGNAVEKVLIDTRNAIFNLYDAFVQEKINTITDLENYLQDK<br>PILIGHLPKQMIDLLKGHQRDMLKAVEQKKAMLIKDTERRLKL |

TABLE 3-continued

| | | |
|---|---|---|
| | | LDKQLKQETDVAAKNTGTLLKNGQIADWLVNDMMRFQPVKR<br>DKEGNPINCSKANSTEYQMLQRAFAFYATDSCRLSRYFTQLHLI<br>HSDNSHLFLSRFEYDKQPNLIAFYAAYLKAKLEFLNELQPQNW<br>ASDNYFLLLRAPKNDRQKLAEGWKNGFNLPRGLFTEKIKTWFN<br>EHKTIVDISDCDIFKNRVGQVARLIPVFFDKKFKDHSQPFYRYDF<br>NVGNVSKPTEANYLSKGKREELFKSYQNKFKNNIPAEKTKEYR<br>EYKNFSLWKKFERELRLIKNQDILIWLMCKNLFDEKIKPKKDIL<br>EPRIAVSYIKLDSLQTNTSTAGSLNALAKVVPMTLAIHIDSPKPK<br>GKAGNNEKENKEFTVYIKEEGTKLLKWGNFKTLLADRRIKGLF<br>SYIEHDDIDLKQHPLTKRRVDLELDLYQTCRIDIFQQTLGLEAQL<br>LDKYSDLNTDNFYQMLIGWRKKEGIPRNIKEDTDFLKDVRNAF<br>SHNQYPDSKKIAFRRIRKENPKELILEEEEGLGIATQMYKEVEKV<br>VNRIKRIELFD |
| HMPREF9<br>712_03108<br>[*Myroides*<br>*odoratimimus*<br>CCUG 10230] | 11<br>(SEQ<br>ID NO:<br>111) | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSDIVIENKVLDFLNSSFVSTALHVKDKYLKTDKTKE<br>FLKETIAAELDILIEAYKKKQIEKKNTRFKANKREDILNAIYNEA<br>FWSFINDKDKDKDKETVVAKGADAYFEKNHHKSNDPDFALNIS<br>EKGIVYLLSFFLTNKEMDSLKANLTGFKGKVDRESGNSIKYMA<br>TQRIYSFHTYRGLKQKIRTSEEGVKETLLMQMIDELSKVPNVVY<br>QHLSTTQQNSFIEDWNEYYKDYEDDVETDDLSRVIHPVIRKRYE<br>DRFNYFAIRFLDEFFDFPTLRFQVHLGDYVHDRRTKQLGKVESD<br>RIIKEKVTVFARLKDINSAKASYFHSLEEQDKEELDNKWTLFPN<br>PSYDFPKEHTLQHQGEQKNAGKIGIYVKLRDTQYKEKAALEEA<br>RKSLNPKERSATKASKYDIITQIIEANDNVKSEKPLVFTGQPIAY<br>LSMNDIHSMLFSLLTDNAELKKTPEEVEAKLIDQIGKQINEILSK<br>DTDTKILKKYKDNDLKETDTDKITRDLARDKEEIEKLILEQKQR<br>ADDYNYTSSTKFNIDKSRKRKHLLFNAEKGKIGVWLANDIKRF<br>MFKESKSKWKGYQHTELQKLFAYFDTSKSDLELILSNMVMVK<br>DYPIELIDLVKKSRTLVDFLNKYLEARLEYIENVITRVKNSIGTP<br>QFKTVRKECFTFLKKSNYTVVSLDKQVERILSMPLFIERGFMDD<br>KPTMLEGKSYKQHKEKFADWFVHYKENSNYQNFYDTEVYEIT<br>TEDKREKAKVTKKIKQQQKNDVFTLMMVNYMLEEVLKLSSND<br>RLSLNELYQTKEERIVNKQVAKDTQERNKNYIWNKVVDLQLC<br>DGLVHIDNVKLKDIGNFRKYENDSRVKEFLTYQSDIVWSAYLS<br>NEVDSNKLYVIERQLDNYESIRSKELLKEVQEIECSVYNQVANK<br>ESLKQSGNENFKQYVLQGLLPIGMDVREMLILSTDVKFKKEEII<br>QLGQAGEVEQDLYSLIYIRNKFAHNQLPIKEFFDFCENNYRSISD<br>NEYYAEYYMEIFRSIKEKYAN |
| *Prevotella*<br>*intermedia* | 12<br>(SEQ<br>ID NO:<br>112) | MEDDKKTTDSIRYELKDKHFWAAFLNLARHNVYITVNHINKIL<br>EEDEINRDGYENTLENSWNEIKDINKKDRLSKLIIKHFPFLEATT<br>YRQNPTDTTKQKEEKQAEAQSLESLKKSFFVFIYKLRDLRNHYS<br>HYKHSKSLERPKFEEDLQNKMYNIFDVSIQFVKEDYKHNTDINP<br>KKDFKHLDRKRKGKFHYSFADNEGNITESGLLFFVSLFLEKKDA<br>IWVQKKLEGFKCSNKSYQKMTNEVFCRSRMLLPKLRLESTQTQ<br>DWILLDMLNELIRCPKSLYERLQGVNRKKFYVSFDPADEDYDA<br>EQEPFKNTLVRHQDRFPYFALRYFDYNEVFANLRFQIDLGTYHF<br>SIYKKLIGGQKEDRHLTHKLYGFERIQEFDKQNRPDEWKAIVKD<br>SDTFKKKEEKEEEKPYISETTPHYHLENKKIGIAFKNHNIWPSTQ<br>TELTNNKRKKYNLGTSIKAEAFLSVHELLPMMFYYLLLKTENT<br>KNDNKVGGKKETKKQGKHKIEAIIESKIKDIYALYDAFANGEIN<br>SEDELKEYLKGKDIKIVHLPKQMIAILKNEHKDMAEKAEAKQE<br>KMKLATENRLKTLDKQLKGKIQNGKRYNSAPKSGEIASWLVN<br>DMMRFQPVQKDENGESLNNSKANSTEYQLLQRTLAFFGSEHER<br>LAPYFKQTKLIESSNPHPFLNDTEWEKCSNILSFYRSYLKARKNF<br>LESLKPEDWEKNQYFLMLKEPKTNRETLVQGWKNGFNLPRGFF<br>TEPIRKWFMEHWKSIKVDDLKRVGLVAKVTPLFFSEKYKDSVQ<br>PFYNYPFNVGDVNKPKEEDFLHREERIELWDKKKDKFKGYKA<br>KKKFKEMTDKEKEEHRSYLEFQSWNKFERELRLVRNQDIVTWL<br>LCTELIDKLKIDELNIKELKKLRLKDINTDTAKKEKNNILNRVMP<br>MELPVTVYKVNKGGYIIKNKPLHTIYIKEAETKLLKQGNFKALV<br>KDRRLNGLFSFVKTPSEAESESNPISKLRVEYELGKYQNARLDII<br>EDMLALEKKLIDKYNSLDTDNFHNMLTGWLELKGEAKKARFQ<br>NDVKLLTAVRNAFSHNQYPMYDENLFGNIERFSLSSSNIIESKGL<br>DIAAKLKEEVSKAAKKIQNEEDNKKEKET |
| *Capnocytophaga*<br>*canimorsus* | 13<br>(SEQ<br>ID NO:<br>113) | MKNIQRLGKGNEFSPFKKEDKFYFGGFLNLANNNIEDFFKEIITR<br>FGIVITDENKKPKETFGEKILNEIFKKDISIVDYEKWVNIFADYFP<br>FTKYLSLYLEEMQFKNRVICFRDVMKELLKTVEALRNFYTHYD<br>HEPIKIEDRVFYFLDKVLLDVSLTVKNKYLKTDKTKEFLNQHIG<br>EELKELCKQRKDYLVGKGKRIDKESEIINGIYNNAFKDFICKREK<br>QDDKENHNSVEKILCNKEPQNKKQKSSATVWELCSKSSSKYTE<br>KSFPNRENDKHCLEVPISQKGIVFLLSFFLNKGEIYALTSNIKGFK<br>AKITKEEPVTYDKNSIRYMATHRMFSFLAYKGLKRKIRTSEINY<br>NEDGQASSTYEKETLMLQMLDELNKVPDVVYQNLSEDVQKTFI<br>EDWNEYLKENNGDVGTMEEEQVIHPVIRKRYEDKFNYFAIRFL<br>DEFAQFPTLRFQVHLGNYLCDKRTKQICDTTTEREVKKKITVFG |

TABLE 3-continued

| | | |
|---|---|---|
| | | RLSELENKKAIFLNEREEIKGWEVFPNPSYDFPKENISVNYKDFP<br>IVGSILDREKQPVSNKIGIRVKIADELQREIDKAIKEKKLRNPKNR<br>KANQDEKQKERLVNEIVSTNSNEQGEPVVFIGQPTAYLSMNDIH<br>SVLYEFLINKISGEALETKIVEKIETQIKQIIGKDATTKILKPYTNA<br>NSNSINREKLLRDLEQEQQILKTLLEEQQQREKDKKDKKSKRK<br>HELYPSEKGKVAVWLANDIKRFMPKAFKEQWRGYHHSLLQKY<br>LAYYEQSKEELKNLLPKEVFKHFPFKLKGYFQQQYLNQFYTDY<br>LKRRLSYVNELLLNIQNFKNDKDALKATEKECFKFFRKQNYIIN<br>PINIQIQSILVYPIFLKRGFLDEKPTMIDREKFKENKDTELADWF<br>MHYKNYKEDNYQKFYAYPLEKVEEKEKFKRNKQINKQKKND<br>VYTLMMVEYIIQKIFGDKFVEENPLVLKGIFQSKAERQQNNTHA<br>ATTQERNLNGILNQPKDIKIQGKITVKGVKLKDIGNFRKYEIDQR<br>VNTFLDYEPRKEWMAYLPNDWKEKEKQGQLPPNNVIDRQISK<br>YETVRSKILLKDVQELEKIISDEIKEEHRHDLKQGKYYNFKYYIL<br>NGLLRQLKNENVENYKVFKLNTNPEKVNITQLKQEATDLEQKA<br>FVLTYIRNKFAHNQLPKKEFWDYCQEKYGKIEKEKTYAEYFAE<br>VFKREKEALIK |
| *Porphyromonas gulae* | 14 (SEQ ID NO: 114) | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKIDHEHNDEVDPHYHFNHLVRKGKKDRYGHNDNP<br>SFKHHFVDGEGMVTEAGLLFFVSLFLEKRDAIWMQKKIRGFKG<br>GTETYQQMTNEVFCRSRISLPKLKLESLRMDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTSPHYHIEKGKIGLRFMPEGQHLWPSPEVGTTRTGRS<br>KYAQDKRLTAEAFLSVHELMPMMFYYFLLREKYSEEVSAERV<br>QGRIKRVIEDVYAVYDAFARDEINTRDELDACLADKGIRRGHLP<br>RQMIAILSQEHKDMEEKIRKKLQEMMADTDHRLDMLDRQTDR<br>KIRIGRKNAGLPKSGVIADWLVRDMMRFQPVAKDASGKPLNNS<br>KANSTEYRMLQRALALFGGEKERLTPYFRQMNLTGGNNPHPFL<br>HETRWESHTNILSFYRSYLRARKAFLERIGRSDRVENRPFLLLKE<br>PKTDRQTLVAGWKGEFHLPRGIFTEAVRDCLIEMGHDEVASYK<br>EVGFMAKAVPLYFERACEDRVQPFYDSPFNVGNSLKPKKGRFL<br>SKEERAEEWERGKERFRDLEAWSYSAARRIEDAFAGIEYASPG<br>NKKKIEQLLRDLSLWEAFESKLKVRADRINLAKLKKEILEAQEH<br>PYHDFKSWQKFERELRLVKNQDIITWMMCRDLMEENKVEGLD<br>TGTLYLKDIRPNVQEQGSLNVLNRVKPMRLPVVVYRADSRGH<br>VHKEEAPLATVYIEERDTKLLKQGNFKSFVKDRRLNGLFSFVDT<br>GGLAMEQYPISKLRVEYELAKYQTARVCVFELTLRLEESLLTRY<br>PHLPDESFREMLESWSDPLLAKWPELHGKVRLLIAVRNAFSHN<br>QYPMYDEAVESSIRKYDPSSPDAIEERMGLNIAHRLSEEVKQAK<br>ETVERIIQA |
| *Prevotella* sp. P5-125 | 15 (SEQ ID NO: 115) | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLNDGCEFLTSTEQPLSGMINNYYTVALRNM<br>NERYGYKTEDLAFIQDKRFKFVKDAYGKKKSQVNTGFFLSLQD<br>YNGDTQKKLHLSGVGIALLICLFLDKQYINIFLSRLPIFSSYNAQS<br>EERRIIIRSFGINSIKLPKDRIHSEKSNKSVAMDMLNEVKRCPDEL<br>FTTLSAEKQSRFRIISDDHNEVLMKRSSDRFVPLLLQYIDYGKLF<br>DHIRFHVNMGKLRYLLKADKTCIDGQTRVRVIEQPLNGFGRLE<br>EAETMRKQENGTFGNSGIRIRDFENMKRDDANPANYPYIVDTY<br>THYILENNKVEMFINDKEDSAPLLPVIEDDRYVVKTIPSCRMSTL<br>EIPAMAFHMFLFGSKKTEKLIVDVHNRYKRLFQAMQKEEVTAE<br>NIASFGIAESDLPQKILDLISGNAHGKDVDAFIRLTVDDMLTDTE<br>RRIKRFKDDRKSIRSADNKMGKRGFKQISTGKLADFLAKDIVLF<br>QPSVNDGENKITGLNYRIMQSAIAVYDSGDDYEAKQQFKLMFE<br>KARLIGKGTTEPHPFLYKVFARSIPANAVEFYERYLIERKFYLTG<br>LSNEIKKGNRVDVPFIRRDQNKWKTPAMKTLGRIYSEDLPVELP<br>RQMFDNEIKSHLKSLPQMEGIDENNANVTYLIAEYMKRVLDDD<br>FQTFYQWNRNYRYMDMLKGEYDRKGSLQHCFTSVEEREGLW<br>KERASRTERYRKQASNKIRSNRQMRNASSEEIETILDKRLSNSR<br>NEYQKSEKVIRRYRVQDALLFLLAKKTLTELADFDGEREKLKEI<br>MPDAEKGILSEIMPMSFTFEKGGKKYTITSEGMKLKNYGDFFVL<br>ASDKRIGNLLELVGSDIVSKEDIMEEFNKYDQCRPEISSIVFNLE<br>KWAFDTYPELSARVDREEKVDFKSILKILLNNKNINKEQSDILR<br>KIRNAFDHNNYPDKGVVEIKALPEIAMSIKKAFGEYAIMK |
| *Flavobacterium branchiophilum* | 16 (SEQ ID NO: 116) | MENLNKILDKENEICISKIFNTKGIAAPITEKALDNIKSKQKNDL<br>NKEARLHYFSIGHSFKQIDTKKVFDYVLIEELKDEKPLKFITLQK<br>DFFTKEFSIKLQKLINSIRNINNHYVHNFNDINLNKIDSNVFHFLK<br>ESFELAIIEKYYKVNKKYPLDNEIVLFLKELFIKDENTALLNYFT<br>NLSKDEAIEYILTFTITENKIWNINNEHNILNIEKGKYLTFEAMLF<br>LITIFLYKNEANHLLPKLYDFKNNKSKQELFTFFSKKFTSQDIDA<br>EEGHLIKFRDMIQYLNHYPTAWNNDLKLESENKNKIMTTKLIDS |

TABLE 3-continued

| | | |
|---|---|---|
| | | IIEFELNSNYPSFATDIQFKKEAKAFLFASNKKRNQTSFSNKSYN<br>EEIRHNPHIKQYRDEIASALTPISFNVKEDKFKIFVKKHVLEEYFP<br>NSIGYEKFLEYNDFTEKEKEDFGLKLYSNPKTNKLIERIDNHKL<br>VKSHGRNQDRFMDFSMRFLAENNYFGKDAFFKCYKFYDTQEQ<br>DEFLQSNENNDDVKFHKGKVTTYIKYEEHLKNYSYWDCPFVEE<br>NNSMSVKISIGSEEKILKIQRNLMIYFLENALYNENVENQGYKL<br>VNNYYRELKKDVEESIASLDLIKSNPDFKSKYKKILPKRLLHNY<br>APAKQDKAPENAFETLLKKADFREEQYKKLLKKAEHEKNKED<br>FVKRNKGKQFKLHFIRKACQMMYFKEKYNTLKEGNAAFEKKD<br>PVIEKRKNKEHEFGHHKNLNITREEFNDYCKWMFAFNGNDSYK<br>KYLRDLFSEKHFFDNQEYKNLFESSVNLEAFYAKTKELFKKWIE<br>TNKPTNNENRYTLENYKNLILQKQVFINVYHFSKYLIDKNLLNS<br>ENNVIQYKSLENVEYLISDFYFQSKLSIDQYKTCGKLFNKLKSN<br>KLEDCLLYEIAYNYIDKKNVHKIDIQKILTSKIILTINDANTPYKIS<br>VPFNKLERYTEMIAIKNQNNLKARFLIDLPLYLSKNKIKKGKDS<br>AGYEIIIKNDLEIEDINTINNKIINDSVKFTEVLMELEKYFILKDKC<br>ILSKNYIDNSEIPSLKQFSKVWIKENENEIINYRNIACHFHLPLLET<br>FDNLLLNVEQKFIKEELQNVSTINDLSKPQEYLILLFIKFKHNNF<br>YLNLFNKNESKTIKNDKEVKKNRVLQKFINQVILKKK |
| *Myroides odoratimimus* | 17 (SEQ ID NO: 117) | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSDIVIENKVLDFLNSSFVSTALHVKDKYLKTDKTKE<br>FLKETIAAELDILIEAYKKKQIEKKNTRFKANKREDILNAIYNEA<br>FWSFINDKDKDKDKETVVAKGADAYFEKNHHKSNDPDFALNIS<br>EKGIVYLLSFFLTNKEMDSLKANLTGFKGKVDRESGNSIKYMA<br>TQRIYSFHTYRGLKQKIRTSEEGVKETLLMQMIDELSKVPNVVY<br>QHLSTTQQNSFIEDWNEYYKDYEDDVETDDLSRVTHPVIRKRY<br>EDRFNYFAIRFLDEFFDFPTLRFQVHLGDYVHDRRTKQLGKVES<br>DRIIKEKVTVFARLKDINSAKASYFHSLEEQDKEELDNKWTLFP<br>NPSYDFPKEHTLQHQGEQKNAGKIGIYVKLRDTQYKEKAALEE<br>ARKSLNPKERSATKASKYDIITQIIEANDNVKSEKPLVFTGQPIA<br>YLSMNDIHSMLFSLLTDNAELKKTPEEVEAKLIDQIGKQINEILS<br>KDTDTKILKKYKDNDLKETDTDKITRDLARDKEEIEKLILEQKQ<br>RADDYNYTSSTKFNIDKSRKRKHLLFNAEKGKIGVWLANDIKR<br>FMFKESKSKWKGYQHIELQKLFAYFDTSKSDLELILSNMVMVK<br>DYPIELIDLVKKSRTLVDFLNKYLEARLEYIENVITRVKNSIGTP<br>QFKTVRKECFTFLKKSNYTVVSLDKQVERILSMPLFIERGFMDD<br>KPTMLEGKSYKQHKEKFADWFVHYKENSNYQNFYDTEVYEIT<br>TEDKREKAKVTKKIKQQQKNDVFTLMMVNYMLEEVLKLSSND<br>RLSLNELYQTKEERIVNKQVAKDTQERNKNYIWNKVVDLQLC<br>DGLVHIDNVKLKDIGNFRKYENDSRVKEFLTYQSDIVWSAYLS<br>NEVDSNKLYVIERQLDNYESIRSKELLKEVQEIECSVYNQVANK<br>ESLKQSGNENFKQYVLQGLLPIGMDVREMLILSTDVKFKKEEII<br>QLGQAGEVEQDLYSLIYIRNKFAHNQLPIKEFFDFCENNYRSISD<br>NEYYAEYYMEIFRSIKEKYAN |
| *Flavobacterium columnare* | 18 (SEQ ID NO: 118) | MSSKNESYNKQKTFNHYKQEDKYFFGGFLNNADDNLRQVGKE<br>FKTRINFNHNNNELASVFKDYFNKEKSVAKREHALNLLSNYFP<br>VLERIQKHTNHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLIPFLEENKTDDKQNKTV<br>SLRKYRKSKPNEETSITLTQSGLVFLMSFFLHRKEFQVFTSGLER<br>FKAKVNTIKEEEISLNKNNIVYMITHWSYSYYNFKGLKHRIKTD<br>QGVSTLEQNNTTHSLTNTNTKEALLTQIVDYLSKVPNEIYETLSE<br>KQQKEFEEDINEYMRENPENEDSTESSIVSHKVIRKRYENKFNY<br>FAMRFLDEYAELPTLRFMVNFGDYIKDRQKKILESIQFDSERIIK<br>KEIHLFEKLSLVTEYKKNVYLKETSNIDLSRFPLFPNPSYVMAN<br>NNIPFYIDSRSNNLDEYLNQKKKAQSQNKKRNLTFEKYNKEQS<br>KDAIIAMLQKEIGVKDLQQRSTIGLLSCNELPSMLYEVIVKDIKG<br>AELENKIAQKIREQYQSIRDFTLDSPQKDNIPTTLIKTINTDSSVT<br>FENQPIDIPRLKNALQKELTLTQEKLLNVKEHEIEVDNYNRNKN<br>TYKFKNQPKNKVDDKKLQRKYVFYRNEIRQEANWLASDLIHF<br>MKNKSLWKGYMHNELQSFLAFFEDKKNDCIALLETVFNLKED<br>CILTKGLKNLFLKHGNFIDFYKEYLKLKEDFLSTESTFLENGFIG<br>LPPKILKKELSKRLKYIFIVFQKRQFIIKELEEKKNNLYADAINLS<br>RGIFDEKPTMIPFKKPNPDEFASWFVASYQYNNYQSFYELTPDI<br>VERDKKKKYKNLRAINKVKIQDYYLKLMVDTLYQDLFNQPLD<br>KSLSDFYVSKAEREKIKADAKAYQKLNDSSLWNKVIHLSLQNN<br>RITANPKLKDIGKYKRALQDEKIATLLTYDARTWTYALQKPEK<br>ENENDYKELHYTALNMELQEYEKVRSKELLKQVQELEKKILDK<br>FYDFSNNASHPEDLEIEDKKGKRHPNFKLYITKALLKNESEIINL<br>ENIDIEILLKYYDYNTEELKEKIKNMDEDEKAKIINTKENYNKIT<br>NVLIKKALVLIIIRNKMAHNQYPPKFIYDLANRFVPKKEEEYFAT<br>YFNRVFETITKELWENKEKKDKTQV |
| *Porphyromonas gingivalis* | 19 (SEQ ID NO: | MTEQNEKPYNGTYYTLEDKHFWAAFLNLARHNAYITLAHIDR<br>QLAYSKADITNDEDILFFKGQWKNLDNDLERKARLRSLILKHFS<br>FLEGAAYGKKLFESQSSGNKSSKKKELSKKEKEELQANALSLD |

TABLE 3-continued

| | | |
|---|---|---|
| | 119) | NLKSILFDFLQKLKDFRNYYSHYRHPESSELPLFDGNMLQRLYN<br>VFDVSVQRVKRDHEHNDKVDPHRHFNHLVRKGKKDKYGNND<br>NPFFKHHFVDREGTVTEAGLLFFVSLFLEKRDAIWMQKKIRGFK<br>GGTEAYQQMTNEVFCRSRISLPKLKLESLRTDDWMLLDMLNEL<br>VRCPKSLYDRLREEDRARFRVPVDILSDEDDTDGTEEDPFKNTL<br>VRHQDRFPYFALRYFDLKKVFTSLRFHIDLGTYHFAIYKKNIGE<br>QPEDRHLTRNLYGFGRIQDFAEEHRPEEWKRLVRDLDYFETGD<br>KPYITQTTPHYHIEKGKIGLRFVPEGQHLWPSPEVGATRTGRSK<br>YAQDKRLTAEAFLSVHELMPMMFYYFLLREKYSEEVSAEKVQ<br>GRIKRVIEDVYAVYDAFARDEINTRDELDACLADKGIRRGHLPR<br>QMIAILSQEHKDMEEKVRKKLQEMIADTDHRLDMLDRQTDRKI<br>RIGRKNAGLPKSGVVADWLVRDMMRFQPVAKDTSGKPLNNSK<br>ANSTEYRMLQRALALFGGEKERLTPYFRQMNLTGGNNPHPFLH<br>ETRWESHTNILSFYRSYLEARKAFLQSIGRSDRVENHRFLLLKEP<br>KTDRQTLVAGWKGEFHLPRGIFTEAVRDCLIEMGYDEVGSYKE<br>VGFMAKAVPLYFERASKDRVQPFYDYPFNVGNSLKPKKGRFLS<br>KEKRAEEWESGKERFRLAKLKKEILEAKEHPYHDFKSWQKFER<br>ELRLVKNQDIITWMMCRDLMEENKVEGLDTGTLYLKDIRTDV<br>QEQGSLNVLNRVKPMRLPVVVYRADSRGHVHKEQAPLATVYI<br>EERDTKLLKQGNFKSFVKDRRLNGLFSFVDTGALAMEQYPISK<br>LRVEYELAKYQTARVCAFEQTLELEESLLTRYPHLPDKNFRKM<br>LESWSDPLLDKWPDLHGNVRLLIAVRNAFSHNQYPMYDETLFS<br>SIRKYDPSSPDAIEERMGLNIAHRLSEEVKQAKEMVERIIQA |
| *Porphyromonas*<br>sp.<br>COT-052<br>OH4946 | 20<br>(SEQ<br>ID NO:<br>120) | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ<br>GRIKRVIEDVYAIYDAFARDEINTLKELDACLADKGIRRGHLPK<br>QMIGILSQERKDMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLH<br>ETRWESHTNILSFYRSYLRARKAFLERIGRSDRVENCPFLLLKEP<br>KTDRQTLVAGWKGEFHLPRGIFTEAVRDCLIEMGYDEVGSYRE<br>VGFMAKAVPLYFERACEDRVQPFYDSPFNVGNSLKPKKGRFLS<br>KEDRAEEWERGKERFRDLEAWSHSAARRIKDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEEAPLATVYIEERDTKLLKQGNFKSFVKDRRLNGLFSFVDTG<br>GLAMEQYPISKLRVEYELAKYQTARVCVFELTLRLEESLLSRYP<br>HLPDESFREMLESWSDPLLAKWPELHGKVRLLIAVRNAFSHNQ<br>YPMYDEAVFSSIRKYDPSSPDAIEERMGLNIAHRLSEEVKQAKE<br>TVERIIQA |
| *Prevotella*<br>*intermedia* | 21<br>(SEQ<br>ID NO:<br>121) | MEDDKKTKESTNMLDNKHFWAAFLNLARHNVYITVNHINKVL<br>ELKNKKDQDIIIDNDQDILAIKTHWEKVNGDLNKTERLRELMTK<br>HFPFLETAIYTKNKEDKEEVKQEKQAKAQSFDSLKHCLFLFLEK<br>LQEARNYYSHYKYSESTKEPMLEKELLKKMYNIFDDNIQLVIK<br>DYQHNKDINPDEDFKHLDRTEEEFNYYFTTNKKGNITASGLLFF<br>VSLFLEKKDAIWMQQKLRGFKDNRESKKKMTHEVFCRSRMLL<br>PKLRLESTQTQDWILLDMLNELIRCPKSLYERLQGEYRKKFNVP<br>FDSADEDYDAEQEPFKNTLVRHQDRFPYFALRYFDYNEIFTNLR<br>FQIDLGTYHFSIYKKLIGGQKEDRHLTHKLYGFERIQEFAKQNR<br>TDEWKAIVKDFDTYETSEEPYISETAPHYHLENQKIGIRFRNDN<br>DEIWPSLKTNGENNEKRKYKLDKQYQAEAFLSVHELLPMMFY<br>YLLLKKEEPNNDKKNASIVEGFIKREIRDIYKLYDAFANGEINNI<br>DDLEKYCEDKGIPKRHLPKQMVAILYDEHKDMAEEAKRKQKE<br>MVKDTKKLLATLEKQTQGEIEDGGRNIRLLKSGEIARWLVNDM<br>MRFQPVQKDNEGNPLNNSKANSTEYQMLQRSLALYNKEEKPT<br>RYFRQVNLINSSNPHPFLKWTKWEECNNILSFYRSYLTKKIEFLN<br>KLKPEDWEKNQYFLKLKEPKTNRETLVQGWKNGFNLPRGIFTE<br>PIREWFKRHQNDSEEYEKVETLDRVGLVTKVIPLFFKKEDSKDK<br>EEYLKKDAQKEINNCVQPFYGFPYNVGNIHKPDEKDFLPSEERK<br>KLWGDKKYKFKGYKAKVKSKKLTDKEKEEYRSYLEFQSWNK<br>FERELRLVRNQDIVTWLLCTELIDKLKVEGLNVEELKKLRLKDI<br>DTDTAKQEKNNILNRVMPMQLPVTVYEIDDSHNIVKDRPLHTV<br>YIEETKTKLLKQGNFKALVKDRRLNGLFSFVDTSSETELKSNPIS<br>KSLVEYELGEYQNARIETIKDMLLLEETLIEKYKTLPTDNFSDM<br>LNGWLEGKDEADKARFQNDVKLLVAVRNAFSHNQYPMRNRIA<br>FANINPFSLSSADTSEEKKLDIANQLKDKTHKIIKRIIEIEKPIETK<br>E |

TABLE 3-continued

| | | |
|---|---|---|
| PIN17_0200 [*Prevotella intermedia* 17] | AFJ07523 (SEQ ID NO: 122) | MKMEDDKKTKESTNMLDNKHFWAAFLNLARHNVYITVNHIN<br>KVLELKNKKDQDIIIDNDQDILAIKTHWEKVNGDLNKTERLREL<br>MTKHFPFLETAIYTKNKEDKEEVKQEKQAKAQSFDSLKHCLFL<br>FLEKLQEARNYYSHYKYSESTKEPMLEKELLKKMYNIFDDNIQ<br>LVIKDYQHNKDINPDEDFKHLDRTEEEFNYYFTTNKKGNITASG<br>LLFFVSLFLEKKDAIWMQQKLRGFKDNRESKKKMTHEVFCRSR<br>MLLPKLRLESTQTQDWILLDMLNELIRCPKSLYERLQGEYRKKF<br>NVPFDSADEDYDAEQEPFKNTLVRHQDRFPYFALRYFDYNEIFT<br>NLRFQIDLGTYHFSIYKKLIGGQKEDRHLTHKLYGFERIQEFAK<br>QNRTDEWKAIVKDFDTYETSEEPYISETAPHYHLENQKIGIRFRN<br>DNDEIWPSLKTNGENNEKRKYKLDKQYQAEAFLSVHELLPMM<br>FYYLLLKKEEPNNDKKNASIVEGFIKREIRDIYKLYDAFANGEIN<br>NIDDLEKYCEDKGIPKRHLPKQMVAILYDEHKDMAEEAKRKQ<br>KEMVKDTKKLLATLEKQTQGEIEDGGRNIRLLKSGEIARWLVN<br>DMMRFQPVQKDNEGNPLNNSKANSTEYQMLQRSLALYNKEEK<br>PTRYFRQVNLINSSNPHPFLKWTKWEECNNILSFYRSYLTKKIEF<br>LNKLKPEDWEKNQYFLKLKEPKTNRETLVQGWKNGFNLPRGIF<br>TEPIREWFKRHQNDSEEYEKVETLDRVGLVTKVIPLFFKKEDSK<br>DKEEYLKKDAQKEINNCVQPFYGFPYNVGNIHKPDEKDFLPSEE<br>RKKLWGDKKYKFKGYKAKVKSKKLTDKEKEEYRSYLEFQSW<br>NKFERELRLVRNQDIVTWLLCTELIDKLKVEGLNVEELKKLRLK<br>DIDTDTAKQEKNNILNRVMPMQLPVTVYEIDDSHNIVKDRPLHT<br>VYIEETKTKLLKQGNFKALVKDRRLNGLFSFVDTSSETELKSNPI<br>SKSLVEYELGEYQNARIETIKDMLLLEETLIEKYKTLPTDNFSDM<br>LNGWLEGKDEADKARFQNDVKLLVAVRNAFSHNQYPMRNRIA<br>FANINPFSLSSADTSEEKKLDIANQLKDKTHKIIKRIIEIEKPIETK<br>E |
| *Prevotella intermedia* | BAU18623 (SEQ ID NO: 123) | MEDDKKTTDSISYELKDKHFWAAFLNLARHNVYITVNHINKVL<br>ELKNKKDQDIIIDNDQDILAIKTHWEKVNGDLNKTERLRELMTK<br>HFPFLETAIYSKNKEDKEEVKQEKQAKAQSFDSLKHCLFLFLEK<br>LQETRNYYSHYKYSESTKEPMLEKELLKKMYNIFDDNIQLVIKD<br>YQHNKDINPDEDFKHLDRTEEDFNYYFTRNKKGNITESGLLFFV<br>SLFLEKKDAIWMQQKLRGFKDNRESKKKMTHEVFCRSRMLLP<br>KLRLESTQTQDWILLDMLNELIRCPKSLYERLQGEDREKFKVPF<br>DPADEDYDAEQEPFKNTLVRHQDRFPYFALRYFDYNEIFTNLRF<br>QIDLGTFHFSIYKKLIGGQKEDRHLTHKLYGFERIQEFAKQNRPD<br>EWKAIVKDLDTYETSNERYISETTPHYHLENQKIGIRFRNDNDEI<br>WPSLKTNGENNEKSKYKLDKQYQAEAFLSVHELLPMMFYYLL<br>LKKEEPNNDKKNASIVEGFIKREIRDMYKLYDAFANGEINNIDD<br>LEKYCEDKGIPKRHLPKQMVAILYDEHKDMVKEAKRKQRKMV<br>KDTEKLLAALEKQTQEKTEDGGRNIRLLKSGEIARWLVNDMM<br>RFQPVQKDNEGNPLNNSKANSTEYQMLQRSLALYNKEEKPTRY<br>FRQVNLINSSNPHPFLKWTKWEECNNILSFYRSYLTKKIEFLNKL<br>KPEDWEKNQYFLKLKEPKTNRETLVQGWKNGFNLPRGIFTEPIR<br>EWFKRHQNDSKEYEKVEALDRVGLVTKVIPLFFKKEDSKDKEE<br>DLKKDAQKEINNCVQPFYSFPYNVGNIHKPDEKDFLHREERIEL<br>WDKKKDKFKGYKAKVKSKKLTDKEKEEYRSYLEFQSWNKFER<br>ELRLVRNQDIVTWLLCTELIDKLKVEGLNVEELKKLRLKDIDTD<br>TAKQEKNNILNRVMPMQLPVTVYEIDDSHNIVKDRPLHTVYIEE<br>TKTKLLKQGNFKALVKDRRLNGLFSFVDTSSEAELKSNPISKSL<br>VEYELGEYQNARIETIKDMLLLEETLIEKYKNLPTDNFSDMLNG<br>WLEGKDEADKARFQNDVKLLVAVRNAFSHNQYPMRNRIAFAN<br>INPFSLSSADTSEEKKLDIANQLKDKTHKIIKRIIEIEKPIETKE |
| HMPREF6 485_0083 [*Prevotella buccae* ATCC 33574] | EFU31981 (SEQ ID NO: 124) | MQKQDKLFVDRKKNAIFAFPKYITIMENKEKPEPIYYELTDKHF<br>WAAFLNLARHNVYTTINHINRRLEIAELKDDGYMMGIKGSWNE<br>QAKKLDKKVRLRDLIMKHFPFLEAAAYEMTNSKSPNNKEQRE<br>KEQSEALSLNNLKNVLFIFLEKLQVLRNYYSHYKYSEESPKPIFE<br>TSLLKNMYKVFDANVRLVKRDYMHHENIDMQRDFTHLNRKK<br>QVGRTKNIIDSPNFHYHFADKEGNMTIAGLLFFVSLFLDKKDAI<br>WMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYHFS<br>IYNKRIGDEDEVRHLTHHLYGFARIQDFAPQNQPEEWRKLVKD<br>LDHFETSQEPYISKTAPHYHLENEKIGIKFCSAHNNLFPSLQTDK<br>TCNGRSKFNLGTQFTAEAFLSVHELLPMMFYYLLLTKDYSRKE<br>SADKVEGIIRKEISNIYAIYDAFANNEINSIADLTRRLQNTNILQG<br>HLPKQMISILKGRQKDMGKEAERKIGEMIDDTQRRLDLLCKQT<br>NQKIRIGKRNAGLLKSGKIADWLVNDMMRFQPVQKDQNNIPIN<br>NSKANSTEYRMLQRALALFGSENFRLKAYFNQMNLVGNDNPH<br>PFLAETQWEHQTNILSFYRNYLEARKKYLKGLKPQNWKQYQH<br>FLILKVQKTNRNTLVTGWKNSFNLPRGIFTQPIREWFEKHNNSK<br>RIYDQILSFDRVGFVAKAIPLYFAEEYKDNVQPFYDYPFNIGNRL<br>KPKKRQFLDKKERVELWQKNKELFKNYPSEKKKTDLAYLDFLS<br>WKKFERELRLIKNQDIVTWLMFKELFNMATVEGLKIGEIHLRDI<br>DTNTANEESNNILNRIMPMKLPVKTYETDNKGNILKERPLATFY<br>IEETETKVLKQGNFKALVKDRRLNGLFSFAETTDLNLEEHPISKL<br>SVDLELIKYQTTRISIFEMTLGLEKKLIDKYSTLPTDSFRNMLER |

TABLE 3-continued

| | | |
|---|---|---|
| | | WLQCKANRPELKNYVNSLIAVRNAFSHNQYPMYDATLFAEVK<br>KFTLFPSVDTKKIELNIAPQLLEIVGKAIKEIEKSENKN |
| HMPREF9<br>144_1146<br>[*Prevotella*<br>*pallens*<br>ATCC<br>700821] | EGQ18444<br>(SEQ<br>ID NO:<br>125) | MKEEEKGKTPVVSTYNKDDKHFWAAFLNLARHNVYITVNHIN<br>KILGEGEINRDGYENTLEKSWNEIKDINKKDRLSKLIIKHFPFLE<br>VTTYQRNSADTTKQKEEKQAEAQSLESLKKSFFVFIYKLRDLRN<br>HYSHYKHSKSLERPKFEEDLQEKMYNIFDASIQLVKEDYKHNT<br>DIKTEEDFKHLDRKGQFKYSFADNEGNITESGLLFFVSLFLEKK<br>DAIWVQKKLEGFKCSNESYQKMTNEVFCRSRMLLPKLRLQSTQ<br>TQDWILLDMLNELIRCPKSLYERLREEDRKKFRVPIEIADEDYD<br>AEQEPFKNALVRHQDRFPYFALRYFDYNEIFTNLRFQIDLGTYH<br>FSIYKKQIGDYKESHHLTHKLYGFERIQEFTKQNRPDEWRKFVK<br>TFNSFETSKEPYIPETTPHYHLENQKIGIRFRNDNDKIWPSLKTNS<br>EKNEKSKYKLDKSFQAEAFLSVHELLPMMFYYLLLKTENTDND<br>NEIETKKKENKNDKQEKHKIEEIIENKITEIYALYDAFANGKINSI<br>DKLEEYCKGKDIEIGHLPKQMIAILKSEHKDMATEAKRKQEEM<br>LADVQKSLESLDNQINEEIENVERKNSSLKSGEIASWLVNDMM<br>RFQPVQKDNEGNPLNNSKANSTEYQMLQRSLALYNKEEKPTRY<br>FRQVNLIESSNPHPFLNNTEWEKCNNILSFYRSYLEAKKNFLESL<br>KPEDWEKNQYFLMLKEPKTNCETLVQGWKNGFNLPRGIFTEPI<br>RKWFMEHRKNITVAELKRVGLVAKVIPLFFSEEYKDSVQPFYN<br>YLFNVGNINKPDEKNFLNCEERRELLRKKKDEFKKMTDKEKEE<br>NPSYLEFQSWNKFERELRLVRNQDIVTWLLCMELFNKKKIKEL<br>NVEKIYLKNINTNTTKKEKNTEEKNGEEKIIKEKNNILNRIMPMR<br>LPIKVYGRENFSKNKKKKIRRNTFFTVYIEEKGTKLLKQGNFKA<br>LERDRRLGGLFSFVKTHSKAESKSNTISKSRVEYELGEYQKARIE<br>IIKDMLALEETLIDKYNSLDTDNFHNMLTGWLKLKDEPDKASF<br>QNDVDLLIAVRNAFSHNQYPMRNRIAFANINPFSLSSANTSEEK<br>GLGIANQLKDKTHKTIEKIIEIEKPIETKE |
| HMPREF9<br>714_02132<br>[*Myroides*<br>*odoratimimus*<br>CCUG<br>12901] | EHO08761<br>(SEQ<br>ID NO:<br>126) | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSEIVIENKVLDFLNSSLVSTALHVKDKYLKTDKTKE<br>FLKETIAAELDILIEAYKKKQIEKKNTRFKANKREDILNAIYNEA<br>FWSFINDKDKDKETVVAKGADAYFEKNHHKSNDPDFALNISEK<br>GIVYLLSFFLTNKEMDSLKANLTGFKGKVDRESGNSIKYMATQ<br>RIYSFHTYRGLKQKIRTSEEGVKETLLMQMIDELSKVPNVVYQH<br>LSTTQQNSFIEDWNEYYKDYEDDVETDDLSRVIHPVIRKRYEDR<br>FNYFAIRFLDEFFDFPTLRFQVHLGDYVHDRRTKQLGKVESDRII<br>KEKVTVFARLKDINSAKANYFHSLEEQDKEELDNKWTLFPNPS<br>YDFPKEHTLQHQGEQKNAGKIGIYVKLRDTQYKEKAALEEARK<br>SLNPKERSATKASKYDIITQIIEANDNVKSEKPLVFTGQPIAYLS<br>MNDIHSMLFSLLTDNAELKKTPEEVEAKLIDQIGKQINEILSKDT<br>DTKILKKYKDNDLKETDTDKITRDLARDKEEIEKLILEQKQRAD<br>DYNYTSSTKFNIDKSRKRKHLLFNAEKGKIGVWLANDIKRFMT<br>EEFKSKWKGYQHTELQKLFAYYDTSKSDLDLILSDMVMVKDY<br>PIELIALVKKSRTLVDFLNKYLEARLGYMENVITRVKNSIGTPQF<br>KTVRKECFTFLKKSNYTVVSLDKQVERILSMPLFIERGFMDDKP<br>TMLEGKSYQQHKEKFADWFVHYKENSNYQNFYDTEVYEITTE<br>DKREKAKVTKKIKQQQKNDVFTLMMVNYMLEEVLKLSSNDRL<br>SLNELYQTKEERIVNKQVAKDTQERNKNYIWNKVVDLQLCEG<br>LVRIDKVKLKDIGNFRKYENDSRVKEFLTYQSDIVWSAYLSNEV<br>DSNKLYVIERQLDNYESIRSKELLKEVQEIECSVYNQVANKESL<br>KQSGNENFKQYVLQGLVPIGMDVREMLILSTDVKFIKEEIIQLG<br>QAGEVEQDLYSLIYIRNKFAHNQLPIKEFFDFCENNYRSISDNEY<br>YAEYYMEIFRSIKEKYTS |
| HMPREF9<br>711_00870<br>[*Myroides*<br>odoratimimus<br>CCUG<br>3837] | EKB06014<br>(SEQ<br>ID NO:<br>127) | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSEIVIENKVLDFLNSSLVSTALHVKDKYLKTDKTKE<br>FLKETIAAELDILIEAYKKKQIEKKNTRFKANKREDILNAIYNEA<br>FWSFINDKDKDKETVVAKGADAYFEKNHHKSNDPDFALNISEK<br>GIVYLLSFFLTNKEMDSLKANLTGFKGKVDRESGNSIKYMATQ<br>RIYSFHTYRGLKQKIRTSEEGVKETLLMQMIDELSKVPNVVYQH<br>LSTTQQNSFIEDWNEYYKDYEDDVETDDLSRVIHPVIRKRYEDR<br>FNYFAIRFLDEFFDFPTLRFQVHLGDYVHDRRTKQLGKVESDRII<br>KEKVTVFARLKDINSAKASYFHSLEEQDKEELDNKWTLFPNPS<br>YDFPKEHTLQHQGEQKNAGKIGIYVKLRDTQYKEKAALEEARK<br>SLNPKERSATKASKYDIITQIIEANDNVKSEKPLVFTGQPIAYLS<br>MNDIHSMLFSLLTDNAELKKTPEEVEAKLIDQIGKQINEILSKDT<br>DTKILKKYKDNDLKETDTDKITRDLARDKEEIEKLILEQKQRAD<br>DYNYTSSTKFNIDKSRKRKHLLFNAEKGKIGVWLANDIKRFMF<br>KESKSKWKGYQHTELQKLFAYFDTSKSDLELILSDMVMVKDYP<br>IELIDLVRKSRTLVDFLNKYLEARLGYIENVITRVKNSIGTPQFKT<br>VRKECFAFLKESNYTVASLDKQIERILSMPLFIERGFMDSKPTML<br>EGKSYQQHKEDFADWFVHYKENSNYQNFYDTEVYEIITEDKRE<br>QAKVTKKIKQQQKNDVFTLMMVNYMLEEVLKLPSNDRLSLNE<br>LYQTKEERIVNKQVAKDTQERNKNYIWNKVVDLQLCEGLVRID |

TABLE 3-continued

| | | |
|---|---|---|
| | | KVKLKDIGNFRKYENDSRVKEFLTYQSDIVWSGYLSNEVDSNK<br>LYVIERQLDNYESIRSKELLKEVQEIECIVYNQVANKESLKQSGN<br>ENFKQYVLQGLLPRGTDVREMLILSTDVKFKKEEIMQLGQVRE<br>VEQDLYSLIYIRNKFAHNQLPIKEFFDFCENNYRPISDNEYYAEY<br>YMEIFRSIKEKYAS |
| HMPREF9<br>699_02005<br>[*Bergeyella*<br>*zoohelcum*<br>ATCC<br>43767] | EKB54193<br>(SEQ<br>ID NO:<br>128) | MENKTSLGNNIYYNPFKPQDKSYFAGYFNAAMENTDSVFRELG<br>KRLKGKEYTSENFFDAIFKENISLVEYERYVKLLSDYFPMARLL<br>DKKEVPIKERKENFKKNFKGIIKAVRDLRNFYTHKEHGEVEITD<br>EIFGVLDEMLKSTVLTVKKKKVKTDKTKEILKKSIEKQLDILCQ<br>KKLEYLRDTARKIEEKRRNQRERGEKELVAPFKYSDKRDDLIA<br>AIYNDAFDVYIDKKKDSLKESSKAKYNTKSDPQQEEGDLKIPIS<br>KNGVVFLLSLFLTKQEIHAFKSKIAGFKATVIDEATVSEATVSHG<br>KNSICFMATHEIFSHLAYKKLKRKVRTAEINYGEAENAEQLSVY<br>AKETLMMQMLDELSKVPDVVYQNLSEDVQKTFIEDWNEYLKE<br>NNGDVGTMEEEQVIHPVIRKRYEDKFNYFAIRFLDEFAQFPTLR<br>FQVHLGNYLHDSRPKENLISDRRIKEKITVFGRLSELEHKKALFI<br>KNTETNEDREHYWEIFPNPNYDFPKENISVNDKDFPIAGSILDRE<br>KQPVAGKIGIKVKLLNQQYVSEVDKAVKAHQLKQRKASKPSIQ<br>NIIEEIVPINESNPKEAIVFGGQPTAYLSMNDIHSILYEFFDKWEK<br>KKEKLEKKGEKELRKEIGKELEKKIVGKIQAQIQQIIDKDTNAKI<br>LKPYQDGNSTAIDKEKLIKDLKQEQNILQKLKDEQTVREKEYN<br>DFIAYQDKNREINKVRDRNHKQYLKDNLKRKYPEAPARKEVL<br>YYREKGKVAVWLANDIKRFMPTDFKNEWKGEQHSLLQKSLAY<br>YEQCKEELKNLLPEKVFQHLPFKLGGYFQQKYLYQFYTCYLDK<br>RLEYISGLVQQAENFKSENKVFKKVENECFKFLKKQNYTHKEL<br>DARVQSILGYPIFLERGFMDEKPTIIKGKTFKGNEALFADWFRY<br>YKEYQNFQTFYDTENYPLVELEKKQADRKRKTKIYQQKKNDV<br>FTLLMAKHIFKSVFKQDSIDQFSLEDLYQSREERLGNQERARQT<br>GERNTNYIWNKTVDLKLCDGKITVENVKLKNVGDFIKYEYDQR<br>VQAFLKYEENIEWQAFLIKESKEEENYPYVVEREIEQYEKVRRE<br>ELLKEVHLIEEYILEKVKDKEILKKGDNQNFKYYILNGLLKQLK<br>NEDVESYKVFNLNTEPEDVNINQLKQEATDLEQKAFVLTYIRN<br>KFAHNQLPKKEFWDYCQEKYGKIEKEKTYAEYFAEVFKKEKE<br>ALIK |
| HMPREF9<br>151_01387<br>[*Prevotella*<br>*saccharolytica*<br>F0055] | EKY00089<br>(SEQ<br>ID NO:<br>129) | MMEKENVQGSHIYYEPTDKCFWAAFYNLARHNAYLTIAHINSF<br>VNSKKGINNDDKVLDIIDDWSKFDNDLLMGARLNKLILKHFPFL<br>KAPLYQLAKRKTRKQQGKEQQDYEKKGDEDPEVIQEAIANAFK<br>MANVRKTLHAFLKQLEDLRNHFSHYNYNSPAKKMEVKFDDGF<br>CNKLYYVFDAALQMVKDDNRMNPEINMQTDFEHLVRLGRNR<br>KIPNTFKYNFTNSDGTINNNGLLFFVSLFLEKRDAIWMQKKIKG<br>FKGGTENYMRMTNEVFCRNRMVIPKLRLETDYDNHQLMFDML<br>NELVRCPLSLYKRLKQEDQDKFRVPIEFLDEDNEADNPYQENA<br>NSDENPTEETDPLKNTLVRHQHRFPYFVLRYFDLNEVFKQLRFQ<br>INLGCYHFSIYDKTIGERTEKRHLTRTLFGFDRLQNFSVKLQPEH<br>WKNMVKHLDTEESSDKPYLSDAMPHYQIENEKIGIHFLKTDTE<br>KKETVWPSLEVEEVSSNRNKYKSEKNLTADAFLSTHELLPMMF<br>YYQLLSSEEKTRAAAGDKVQGVLQSYRKKIFDIYDDFANGTINS<br>MQKLDERLAKDNLLRGNMPQQMLAILEHQEPDMEQKAKEKL<br>DRLITETKKRIGKLEDQFKQKVRIGKRRADLPKVGSIADWLVND<br>MMRFQPAKRNADNTGVPDSKANSTEYRLLQEALAFYSAYKDR<br>LEPYFRQVNLIGGTNPHPFLHRVDWKKCNHLLSFYHDYLEAKE<br>QYLSHLSPADWQKHQHFLLLKVRKDIQNEKKDWKKSLVAGW<br>KNGFNLPRGLFTESIKTWFSTDADKVQITDTKLFENRVGLIAKLI<br>PLYYDKVYNDKPQPFYQYPFNINDRYKPEDTRKRFTAASSKLW<br>NEKKMLYKNAQPDSSDKIEYPQYLDFLSWKKLERELRMLRNQ<br>DMMVWLMCKDLFAQCTVEGVEFADLKLSQLEVDVNVQDNLN<br>VLNNVSSMILPLSVYPSDAQGNVLRNSKPLHTVYVQENNTKLL<br>KQGNFKSLLKDRRLNGLFSFIAAEGEDLQQHPLTKNRLEYELSI<br>YQTMRISVFEQTLQLEKAILTRNKTLCGNNFNNLLNSWSEHRTD<br>KKTLQPDIDFLIAVRNAFSHNQYPMSTNTVMQGIEKFNIQTPKL<br>EEKDGLGIASQLAKKTKDAASRLQNIINGGTN |
| A343_1752<br>[*Porphyromonas*<br>*gingivalis*<br>JCVI<br>SC001] | EOA10535<br>(SEQ<br>ID NO:<br>130) | MTEQNEKPYNGTYYTLEDKHFWAAFFNLARHNAYITLTHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRCGNNDN<br>PFFKHHFVDREEKVTEAGLLFFVSLFLEKRDAIWMQKKIRGFKG<br>GTETYQQMTNEVFCRSRISLPKLKLESLRTDDWMLLDMLNELV<br>RCPKSLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQLLWPSPEVGATRTGRSKY<br>AQDKRFTAEAFLSVHELMPMMFYYFLLREKYSEEASAERVQGR<br>IKRVIEDVYAVYDAFARGEIDTLDRLDACLADKGIRRGHLPRQ<br>MIAILSQEHKDMEEKVRKKLQEMIADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE |

TABLE 3-continued

| | | |
|---|---|---|
| | | TRWESHTNILSFYRSYLKARKAFLQSIGRSDRVENHRFLLLKEP<br>KTDRQTLVAGWKGEFHLPRGIFTEAVRDCLIEMGLDEVGSYKE<br>VGFMAKAVPLYFERACKDRVQPFYDYPFNVGNSLKPKKGRFLS<br>KEKRAEEWESGKERFRDLEAWSHSAARRIEDAFAGIENASREN<br>KKKIEQLLQDLSLWETFESKLKVKADKINIAKLKKEILEAKEHP<br>YLDFKSWQKFERELRLVKNQDIITWMMCRDLMEENKVEGLDT<br>GTLYLKDIRTDVHEQGSLNVLNRVKPMRLPVVVYRADSRGHV<br>HKEQAPLATVYIEERDTKLLKQGNFKSFVKDRRLNGLFSFVDT<br>GALAMEQYPISKLRVEYELAKYQTARVCAFEQTLELEESLLTRY<br>PHLPDKNFRKMLESWSDPLLDKWPDLHGNVRLLIAVRNAFSHN<br>QYPMYDETLFSSIRKYDPSSPDAIEERMGLNIAHRLSEEVKQAK<br>EMVERIIQA |
| HMPREF1<br>981_03090<br>[*Bacteroides*<br>*pyogenes*<br>F0041] | ERI81700<br>(SEQ<br>ID NO:<br>131) | MESIKNSQKSTGKTLQKDPPYFGLYLNMALLNVRKVENHIRKW<br>LGDVALLPEKSGFHSLLTTDNLSSAKWTRFYYKSRKFLPFLEMF<br>DSDKKSYENRRETTECLDTIDRQKISSLLKEVYGKLQDIRNAFS<br>HYHIDDQSVKHTALIISSEMHRFIENAYSFALQKTRARFTGVFVE<br>TDFLQAEEKGDNKKFFAIGGNEGIKLKDNALIFLICLFLDREEAF<br>KFLSRATGFKSTKEKGFLAVRETFCALCCRQPHERLLSVNPREA<br>LLMDMLNELNRCPDILFEMLDEKDQKSFLPLLGEEEQAHILENS<br>LNDELCEAIDDPFEMIASLSKRVRYKNRFPYLMLRYIEEKNLLPF<br>IRFRIDLGCLELASYPKKMGEENNYERSVTDHAMAFGRLTDFH<br>NEDAVLQQITKGITDEVRFSLYAPRYAIYNNKIGFVRTGGSDKIS<br>FPTLKKKGGEGHCVAYTLQNTKSFGFISIYDLRKILLLSFLDKDK<br>AKNIVSGLLEQCEKHWKDLSENLFDAIRTELQKEFPVPLIRYTLP<br>RSKGGKLVSSKLADKQEKYESEFERRKEKLTEILSEKDFDLSQIP<br>RRMIDEWLNVLPTSREKKLKGYVETLKLDCRERLRVFEKREKG<br>EHPVPPRIGEMATDLAKDIIRMVIDQGVKQRITSAYYSEIQRCLA<br>QYAGDDNRRHLDSIIRELRLKDTKNGHPFLGKVLRPGLGHTEK<br>LYQRYFEEKKEWLEATFYPAASPKRVPRFVNPPTGKQKELPLII<br>RNLMKERPEWRDWKQRKNSHPIDLPSQLFENEICRLLKDKIGKE<br>PSGKLKWNEMFKLYWDKEFPNGMQRFYRCKRRVEVFDKVVE<br>YEYSEEGGNYKKYYEALIDEVVRQKISSSKEKSKLQVEDLTLSV<br>RRVFKRAINEKEYQLRLLCEDDRLLFMAVRDLYDWKEAQLDL<br>DKIDNMLGEPVSVSQVIQLEGGQPDAVIKAECKLKDVSKLMRY<br>CYDGRVKGLMPYFANHEATQEQVEMELRHYEDHRRRVFNWV<br>FALEKSVLKNEKLRRFYEESQGGCEHRRCIDALRKASLVSEEEY<br>EFLVHIRNKSAHNQFPDLEIGKLPPNVTSGFCECIWSKYKAIICRI<br>IPFIDPERRFFGKLLEQK |
| HMPREF1<br>553_02065<br>[*Porphyromonas*<br>*gingivalis*<br>F0568] | ERJ65637<br>(SEQ<br>ID NO:<br>132) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| HMPREF1<br>988_01768<br>[*Porphyromonas*<br>*gingivalis*<br>F0185] | ERJ81987<br>(SEQ<br>ID NO:<br>133) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS |

TABLE 3-continued

| | | |
|---|---|---|
| | | VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |
| HMPREF1 990_01800 [*Porphyromonas gingivalis* W4087] | ERJ87335 (SEQ ID NO: 134) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIHGKSVSYIPSDGKKFADCYTHL<br>MEKTVRDKKRELRTAGKPVPPDLAAYIKRSFHRAVNEREFMLR<br>LVQEDDRLMLMAINKIMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEIPLIYRDVSAKVGSIEGSSAKDLPEG<br>SSLVDSLWKKYEMIIRKILPILDPENRFFGKLLNNMSQPINDL |
| M573_117042 [*Prevotella intermedia* ZT] | KJJ86756 (SEQ ID NO: 135) | MKMEDDKKTTESTNMLDNKHFWAAFLNLARHNVYITVNHINK<br>VLELKNKKDQDIIIDNDQDILAIKTHWEKVNGDLNKTERLRELM<br>TKHFPFLETAIYTKNKEDKEEVKQEKQAEAQSLESLKDCLFLFL<br>EKLQEARNYYSHYKYSESTKEPMLEEGLLEKMYNIFDDNIQLVI<br>KDYQHNKDINPDEDFKHLDRKGQFKYSFADNEGNITESGLLFF<br>VSLFLEKKDAIWMQQKLTGFKDNRESKKKMTHEVFCRRRMLL<br>PKLRLESTQTQDWILLDMLNELIRCPKSLYERLQGEYRKKFNVP<br>FDSADEDYDAEQEPFKNTLVRHQDRFPYFALRYFDYNEIFTNLR<br>FQIDLGTYHFSIYKKLIGGQKEDRHLTHKLYGFERIQEFAKQNRP<br>DEWKALVKDLDTYETSNERYISETTPHYHLENQKIGIRFRNGNK<br>EIWPSLKTNGENNEKSKYKLDKPYQAEAFLSVHELLPMMFYYL<br>LLKKEEPNNDKKNASIVEGFIKREIRDMYKLYDAFANGEINNIG<br>DLEKYCEDKGIPKRHLPKQMVAILYDEPKDMVKEAKRKQKEM<br>VKDTKKLLATLEKQTQEEIEDGGRNIRLLKSGEIARWLVNDMM<br>RFQPVQKDNEGNPLNNSKANSTEYQMLQRSLALYNKEEKPTRY<br>FRQVNLINSSNPHPFLKWTKWEECNNILSFYRNYLTKKIEFLNK<br>LKPEDWEKNQYFLKLKEPKTNRETLVQGWKNGFNLPRGIFTEPI<br>REWFKRHQNDSKEYEKVEALKRVGLVTKVIPLFFKEEYFKEDA<br>QKEINNCVQPFYSFPYNVGNIHKPDEKDFLPSEERKKLWGDKK<br>DKFKGYKAKVKSKKLTDKEKEEYRSYLEFQSWNKFERELRLV<br>RNQDIVTWLLCTELIDKMKVEGLNVEELQKLRLKDIDTDTAKQ<br>EKNNILNRIMPMQLPVTVYEIDDSHNIVKDRPLHTVYIEETKTKL<br>LKQGNFKALVKDRRLNGLFSFVDTSSKAELKDKPISKSVVEYEL<br>GEYQNARIETIKDMLLLEKTLIKKYEKLPTDNFSDMLNGWLEG<br>KDESDKARFQNDVKLLVAVRNAFSHNQYPMRNRIAFANINPFS<br>LSSADISEEKKLDIANQLKDKTHKIIKKIIEIEKPIETKE |
| A2033_10205 [*Bacteroidetes bacterium* GWA2 319] | OFX18020.1 (SEQ ID NO: 136) | MENQTQKGKGIYYYYTKNEDKHYFGSFLNLANNNIEQIIEEFRI<br>RLSLKDEKNIKEIINNYFTDKKSYTDWERGINILKEYLPVIDYLD<br>LAITDKEFEKIDLKQKETAKRKYFRTNFSLLIDTIIDLRNFYTHYF<br>HKPISINPDVAKFLDKNLLNVCLDIKKQKMKTDKTKQALKDGL<br>DKELKKLIELKKAELKEKKIKTWNITENVEGAVYNDAFNHMVY<br>KNNAGVTILKDYHKSILPDDKIDSELKLNFSISGLVFLLSMFLSK<br>KEIEQFKSNLEGFKGKVIGENGEYEISKFNNSLKYMATHWIFSY<br>LTFKGLKQRVKNTFDKETLLMQMIDELNKVPHEVYQTLSKEQQ<br>NEFLEDINEYVQDNEENKKSMENSIVVHPVIRKRYDDKFNYFAI<br>RFLDEFANFPTLKFFVTAGNFVHDKREKQIQGSMLTSDRMIKEK<br>INVFGKLTEIAKYKSDYFSNENTLETSEWELFPNPSYLLIQNNIPV<br>HIDLIHNTEEAKQCQIAIDRIKCTTNPAKKRNTRKSKEEIIKIIYQ |

TABLE 3-continued

| | | |
|---|---|---|
| | | KNKNIKYGDPTALLSSNELPALIYELLVNKKSGKELENIIVEKIV<br>NQYKTIAGFEKGQNLSNSLITKKLKKSEPNEDKINAEKIILAINRE<br>LEITENKLNIIKNNRAEFRTGAKRKHIFYSKELGQEATWIAYDLK<br>RFMPEASRKEWKGFHHSELQKFLAFYDRNKNDAKALLNMFW<br>NFDNDQLIGNDLNSAFREFHFDKFYEKYLIKRDEILEGFKSFISN<br>FKDEPKLLKKGIKDIYRVFDKRYYIIKSTNAQKEQLLSKPICLPR<br>GIFDNKPTYIEGVKVESNSALFADWYQYTYSDKHEFQSFYDMP<br>RDYKEQFEKFELNNIKSIQNKKNLNKSDKFIYFRYKQDLKIKQIK<br>SQDLFIKLMVDELFNVVFKNNIELNLKKLYQTSDERFKNQLIAD<br>VQKNREKGDTSDNKMNENFIWNMTIPLSLCNGQIEEPKVKLKD<br>IGKFRKLETDDKVIQLLEYDKSKVWKKLEIEDELENMPNSYERI<br>RREKLLKGIQEFEHFLLEKEKFDGINHPKHFEQDLNPNFKTYVIN<br>GVLRKNSKLNYTEIDKLLDLEHISIKDIETSAKEIHLAYFLIHVRN<br>KFGHNQLPKLEAFELMKKYYKKNNEETYAEYFHKVSSQIVNEF<br>KNSLEKHS |
| SAMN054<br>21542_0666<br>[*Chryseo-*<br>*bacterium*<br>*jejuense*] | SDI27289.1<br>(SEQ<br>ID NO:<br>137) | MEKTQTGLGIYYDHTKLQDKYFFGGFFNLAQNNIDNVIKAFIIK<br>FFPERKDKDINIAQFLDICFKDNDADSDFQKKNKFLRIHFPVIGF<br>LTSDNDKAGFKKKFALLLKTISELRNFYTHYYHKSIEFPSELFEL<br>LDDIFVKTTSEIKKLKKKDDKTQQLLNKNLSEEYDIRYQQQIER<br>LKELKAQGKRVSLTDETAIRNGVFNAAFNHLIYRDGENVKPSR<br>LYQSSYSEPDPAENGISLSQNSILFLLSMFLERKETEDLKSRVKG<br>FKAKIIKQGEEQISGLKFMATHWVFSYLCFKGIKQKLSTEFHEET<br>LLIQIIDELSKVPDEVYSAFDSKTKEKFLEDINEYMKEGNADLSL<br>EDSKVIHPVIRKRYENKFNYFAIRFLDEYLSSTSLKFQVHVGNY<br>VHDRRVKHINGTGFQTERIVKDRIKVFGRLSNISNLKADYIKEQ<br>LELPNDSNGWEIFPNPSYIFIDNNVPIHVLADEATKKGIELFKDK<br>RRKEQPEELQKRKGKISKYNIVSMIYKEAKGKDKLRIDEPLALL<br>SLNEIPALLYQILEKGATPKDIELIIKNKLTERFEKIKNYDPETPAP<br>ASQISKRLRNNTTAKGQEALNAEKLSLLIEREIENTETKLSSIEEK<br>RLKAKKEQRRNTPQRSIFSNSDLGRIAAWLADDIKRFMPAEQRK<br>NWKGYQHSQLQQSLAYFEKRPQEAFLLLKEGWDTSDGSSYWN<br>NWVMNSFLENNHFEKFYKNYLMKRVKYFSELAGNIKQHTHNT<br>KFLRKFIKQQMPADLFPKRHYILKDLETEKNKVLSKPLVFSRGL<br>FDNNPTFIKGVKVTENPELFAEWYSYGYKTEHVFQHFYGWERD<br>YNELLDSELQKGNSFAKNSIYYNRESQLDLIKLKQDLKIKKIKIQ<br>DLFLKRIAEKLFENVFNYPTTLSLDEFYLTQEERAEKERIALAQS<br>LREEGDNSPNIIKDDFIWSKTIAFRSKQIYEPAIKLKDIGKFNRFV<br>LDDEESKASKLLSYDKNKIWNKEQLERELSIGENSYEVIRREKL<br>FKEIQNLELQILSNWSWDGINHPREFEMEDQKNTRHPNFKMYL<br>VNGILRKNINLYKEDEDFWLESLKENDFKTLPSEVLETKSEMVQ<br>LLFLVILIRNQFAHNQLPEIQFYNFIRKNYPEIQNNTVAELYLNLI<br>KLAVQKLKDNS |
| SAMN054<br>44360_11366<br>[*Chryseo-*<br>*bacterium*<br>*carnipullorum*] | SHM52812.1<br>(SEQ<br>ID NO:<br>138) | MNTRVTGMGVSYDHTKKEDKHFFGGFLNLAQDNITAVIKAFCI<br>KFDKNPMSSVQFAESCFTDKDSDTDFQNKVRYVRTHLPVIGYL<br>NYGGDRNTFRQKLSTLLKAVDSLRNFYTHYYHSPLALSTELFEL<br>LDTVFASVAVEVKQHKMKDDKTRQLLSKSLAEELDIRYKQQLE<br>RLKELKEQGKNIDLRDEAGIRNGVLNAAFNHLIYKEGEIAKPTL<br>SYSSFYYGADSAENGITISQSGLLFLLSMFLGKKEIEDLKSRIRGF<br>KAKIVRDGEENISGLKFMATHWIFSYLSFKGMKQRLSTDFHEET<br>LLIQIIDELSKVPDEVYHDFDTATREKFVEDINEYIREGNEDFSLG<br>DSTIIHPVIRKRYENKFNYFAVRFLDEFIKFPSLRFQVHLGNFVH<br>DRRIKDIHGTGFQTERVVKDRIKVFGKLSEISSLKTEYIEKELDL<br>DSDTGWEIFPNPSYVFIDNNIPIYISTNKTFKNGSSEFIKLRRKEKP<br>EEMKMRGEDKKEKRDIASMIGNAGSLNSKTPLAMLSLNEMPAL<br>LYEILVKKTTPEEIELIIKEKLDSHFENIKNYDPEKPLPASQISKRL<br>RNNTTDKGKKVINPEKLIHLINKEIDATEAKFALLAKNRKELKE<br>KFRGKPLRQTIFSNMELGREATWLADDIKRFMPDILRKNWKGY<br>QHNQLQQSLAFFNSRPKEAFTILQDGWDFADGSSFWNGWIINSF<br>VKNRSFEYFYEAYFEGRKEYFSSLAENIKQHTSNHRNLRRFIDQ<br>QMPKGLFENRHYLLENLETEKNKILSKPLVFPRGLFDTKPTFIKG<br>IKVDEQPELFAEWYQYGYSTEHVFQNFYGWERDYNDLLESELE<br>KDNDFSKNSIHYSRTSQLELIKLKQDLKIKKIKIQDLFLKLIAGHI<br>FENIFKYPASFSLDELYLTQEERLNKEQEALIQSQRKEGDHSDNII<br>KDNFIGSKTVTYESKQISEPNVKLKDIGKFNRFLLDDKVKTLLS<br>YNEDKVWNKNDLDLELSIGENSYEVIRREKLFKKIQNFELQTLT<br>DWPWNGTDHPEEFGTTDNKGVNHPNFKMYVVNGILRKHTDW<br>FKEGEDNWLENLNETHFKNLSFQELETKSKSIQTAFLIIMIRNQF<br>AHNQLPAVQFFEFIQKKYPEIQGSTTSELYLNFINLAVVELLELL<br>EK |
| SAMN054<br>21786_1011119<br>[*Chryseo-*<br>*bacterium*<br>*ureilyticum*] | SIS70481.1<br>(SEQ<br>ID NO:<br>139) | METQILGNGISYDHTKTEDKHFFGGFLNTAQNNIDLLIKAYISKF<br>ESSPRKLNSVQFPDVCFKKNDSDADFQHKLQFIRKHLPVIQYLK<br>YGGNREVLKEKFRLLLQAVDSLRNFYTHFYHKPIQLPNELLTLL<br>DTIFGEIGNEVRQNKMKDDKTRHLLKKNLSEELDFRYQEQLER<br>LRKLKSEGKKVDLRDTEAIRNGVLNAAFNHLIFKDAEDFKPTVS<br>YSSYYYDSDTAENGISISQSGLLFLLSMFLGRREMEDLKSRVRG<br>FKARIIKHEEQHVSGLKFMATHWVFSEFCFKGIKTRLNADYHEE<br>TLLIQLIDELSKVPDELYRSFDVATRERFIEDINEYIRDGKEDKSL |

TABLE 3-continued

| | | |
|---|---|---|
| | | IESKIVHPVIRKRYESKFNYFAIRFLDEFVNFPTLRFQVHAGNYV HDRRIKSIEGTGFKTERLVKDRIKVFGKLSTISSLKAEYLAKAVN ITDDTGWELLPHPSYVFIDNNIPIHLTVDPSFKNGVKEYQEKRKL QKPEEMKNRQGGDKMHKPAISSKIGKSKDINPESPVALLSMNEI PALLYEILVKKASPEEVEAKIRQKLTAVFERIRDYDPKVPLPASQ VSKRLRNNTDTLSYNKEKLVELANKEVEQTERKLALITKNRRE CREKVKGKFKRQKVFKNAELGTEATWLANDIKRFMPEEQKKN WKGYQHSQLQQSLAFFESRPGEARSLLQAGWDFSDGSSFWNG WVMNSFARDNTFDGFYESYLNGRMKYFLRLADNIAQQSSTNK LISNFIKQQMPKGLFDRRLYMLEDLATEKNKILSKPLIFPRGIFD DKPTFKKGVQVSEEPEAFADWYSYGYDVKHKFQEFYAWDRD YEELLREELEKDTAFTKNSIHYSRESQIELLAKKQDLKVKKVRI QDLYLKLMAEFLFENVFGHELALPLDQFYLTQEERLKQEQEAIV QSQRPKGDDSPNIVKENFIWSKTIPFKSGRVFEPNVKLKDIGKFR NLLTDEKVDILLSYNNTEIGKQVIENELIIGAGSYEFIRREQLFKEI QQMKRLSLRSVRGMGVPIRLNLK |
| *Prevotella buccae* | WP_004343581 (SEQ ID NO: 140) | MQKQDKLFVDRKKNAIFAFPKYITIMENQEKPEPIYYELTDKHF WAAFLNLARHNVYTTINHINRRLEIAELKDDGYMMDIKGSWNE QAKKLDKKVRLRDLIMKHFPFLEAAAYEITNSKSPNNKEQREK EQSEALSLNNLKNVLFIFLEKLQVLRNYYSHYKYSEESPKPIFET SLLKNMYKVFDANVRLVKRDYMHHENIDMQRDFTHLNRKKQ VGRTKNIIDSPNFHYHFADKEGNMTIAGLLFFVSLFLDKKDAIW MQKKLKGFKDGRNLREQMTNEVFCRSRISLPKLKLENVQTKD WMQLDMLNELVRCPKSLYERLREKDRESFKVPFDIFSDDYDAE EEPFKNTLVRHQDRFPYFVLRYFDLNEIFEQLRFQIDLGTYHFSI YNKRIGDEDEVRHLTHHLYGFARIQDFAQQNQPEVWRKLVKD LDYFEASQEPYIPKTAPHYHLENEKIGIKFCSTHNNLFPSLKTEK TCNGRSKFNLGTQFTAEAFLSVHELLPMMFYYLLLTKDYSRKE SADKVEGIIRKEISNIYAIYDAFANGEINSIADLTCRLQKTNILQG HLPKQMISILEGRQKDMEKEAERKIGEMIDDTQRRLDLLCKQTN QKIRIGKRNAGLLKSGKIADWLVNDMMRFQPVQKDQNNIPINN SKANSTEYRMLQRALALFGSENFRLKAYFNQMNLVGNDNPHP FLAETQWEHQTNILSFYRNYLEARKKYLKGLKPQNWKQYQHF LILKVQKTNRNTLVTGWKNSFNLPRGIFTQPIREWFEKHNNSKR IYDQILSFDRVGFVAKAIPLYFAEEYKDNVQPFYDYPFNIGNKL KPQKGQFLDKKERVELWQKNKELFKNYPSEKKKTDLAYLDFL SWKKFERELRLIKNQDIVTWLMFKELFNMATVEGLKIGEIHLRD IDTNTANEESNNILNRIMPMKLPVKTYETDNKGNILKERPLATF YIEETETKVLKQGNFKVLAKDRRLNGLLSFAETTDIDLEKNPITK LSVDHELIKYQTTRISIFEMTLGLEKKLINKYPTLPTDSFRNMLE RWLQCKANRPELKNYVNSLIAVRNAFSHNQYPMYDATLFAEV KKFTLFPSVDTKKIELNIAPQLLEIVGKAIKEIEKSENKN |
| *Porphyromonas gingivalis* | WP_005873511 (SEQ ID NO: 141) | MNTVPASENKGQSRTVEDDPQYFGLYLNLARNLIEVESHVRIK FGKKKLNEESLKQSLLCDHLLSVDRWTKVYGHSRRYLPFLHYF DPDSQIEKDHDSKTGVDPDSAQRLIRELYSLLDFLRNDFSHNRL DGTTFEHLEVSPDISSFITGTYSLACGRAQSRFADFFKPDDFVLA KNRKEQLISVADGKECLTVSGLAFFICLFLDREQASGMLSRIRGF KRTDENWARAVHETFCDLCIRHPHDRLESSNTKEALLLDMLNE LNRCPRILYDMLPEEERAQFLPALDENSMNNLSENSLNEESRLL WDGSSDWAEALTKRIRHQDRFPYLMLRFIEEMDLLKGIRFRVD MISGEASYPVRFSLFAPRYAIYDNKIGYCHTSDPVYPKSKTGEK RALSNPQSMGFISVHNLRKLLLMELLCEGSFSRMQSDFLRKANR ILDETAEGKLQFSALFPEMRHRFIPPQNPKSKDRREKAETTLEKY KQEIKGRKDKLNSQLLSAFDMNQRQLPSRLLDEWMNIRPASHS VKLRTYVKQLNEDCRLRLRKFRKDGDGKARAIPLVGEMATFLS QDIVRMIISEETKKLITSAYYNEMQRSLAQYAGEENRRQFRAIV AELHLLDPSSGHPFLSATMETAHRYTEDFYKCYLEKKREWLAK TFYRPEQDENTKRRISVFFVPDGEARKLLPLLIRRRMKEQNDLQ DWIRNKQAHPIDLPSHLFDSKIMELLKVKDGKKKWNEAFKDW WSTKYPDGMQPFYGLRRELNIHGKSVSYIPSDGKKFADCYTHL MEKTVQDKKRELRTAGKPVPPDLAADIKRSFHRAVNEREFMLR LVQEDDRLMLMAINKMMTDREEDILPGLKNIDSILDEENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEMPLIYRDVSAKVGSIEGSSAKDLPE GSSLVDSLWKKYEMIIRKILPILDPENRFFGKLLNNMSQPINDL |
| *Porphyromonas gingivalis* | WP_005874195 (SEQ ID NO: 142) | MTEQNEKPYNGTYYTLEDKHFWAAFFNLARHNAYITLAHIDRQ LAYSKADITNDEDILFFKGQWKNLDNDLERKARLRSLILKHFSF LEGAAYGKKLFESQSSGNKSSKKKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDKYGNNDN PFFKHHFVDREEKVTEAGLLFFVSLFLEKRDAIWMQKKIRGFKG GTEAYQQMTNEVFCRSRISLPKLKLESLRTDDWMLLDMLNELV RCPKSLYDRLREEDRARFRVPVDILSDEDDTDGTEEDPFKNTLV RHQDRFPYFALRYFDLKKVFTSLRFHIDLGTYHFAIYKKNIGEQ PEDRHLTRNLYGFGRIQDFAEEHRPEEWKRLVRDLDYFETGDK |

TABLE 3-continued

| | | |
|---|---|---|
| | | PYITQTTPHYHIEKGKIGLRFVPEGQLLWPSPEVGATRTGRSKY<br>AQDKRFTAEAFLSVHELMPMMFYYFLLREKYSEEASAEKVQG<br>RIKRVIEDVYAVYDAFARDEINTRDELDACLADKGIRRGHLPRQ<br>MIAILSQEHKDMEEKVRKKLQEMIADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDREENHRFLLLKEPK<br>TDRQTLVAGWKSEFHLPRGIFTEAVRDCLIEMGYDEVGSYKEV<br>GFMAKAVPLYFERACKDRVQPFYDYPFNVGNSLKPKKGRFLSK<br>EKRAEEWESGKERFRDLEAWSHSAARRIEDAFVGIEYASWENK<br>KKIEQLLQDLSLWETFESKLKVKADKINIAKLKKEILEAKEHPY<br>HDFKSWQKFERELRLVKNQDIITWMMCRDLMEENKVEGLDTG<br>TLYLKDIRTDVQEQGSLNVLNHVKPMRLPVVVYRADSRGHVH<br>KEEAPLATVYIEERDTKLLKQGNFKSFVKDRRLNGLFSFVDTGA<br>LAMEQYPISKLRVEYELAKYQTARVCAFEQTLELEESLLTRYPH<br>LPDESFREMLESWSDPLLDKWPDLQREVRLLIAVRNAFSHNQY<br>PMYDETIFSSIRKYDPSSLDAIEERMGLNIAHRLSEEVKLAKEMV<br>ERIIQA |
| *Prevotella pallens* | WP_006044833 (SEQ ID NO: 143) | MKEEEKGKTPVVSTYNKDDKHFWAAFLNLARHNVYITVNHIN<br>KILGEGEINRDGYENTLEKSWNEIKDINKKDRLSKLIIKHFPFLE<br>VTTYQRNSADTTKQKEEKQAEAQSLESLKKSFFVFIYKLRDLRN<br>HYSHYKHSKSLERPKFEEDLQEKMYNIFDASIQLVKEDYKHNT<br>DIKTEEDFKHLDRKGQFKYSFADNEGNITESGLLFFVSLFLEKK<br>DAIWVQKKLEGFKCSNESYQKMTNEVFCRSRMLLPKLRLQSTQ<br>TQDWILLDMLNELIRCPKSLYERLREEDRKKFRVPIEIADEDYD<br>AEQEPFKNALVRHQDRFPYFALRYFDYNEIFTNLRFQIDLGTYH<br>FSIYKKQIGDYKESHHLTHKLYGFERIQEFTKQNRPDEWRKFVK<br>TFNSFETSKEPYIPETTPHYHLENQKIGIRFRNDNDKIWPSLKTNS<br>EKNEKSKYKLDKSFQAEAFLSVHELLPMMFYYLLLKTENTDND<br>NEIETKKKENKNDKQEKHKIEEIIENKITEIYALYDAFANGKINSI<br>DKLEEYCKGKDIEIGHLPKQMIAILKSEHKDMATEAKRKQEEM<br>LADVQKSLESLDNQINEEIENVERKNSSLKSGEIASWLVNDMM<br>RFQPVQKDNEGNPLNNSKANSTEYQMLQRSLALYNKEEKPTRY<br>FRQVNLIESSNPHPFLNNTEWEKCNNILSFYRSYLEAKKNFLESL<br>KPEDWEKNQYFLMLKEPKTNCETLVQGWKNGFNLPRGIFTEPI<br>RKWFMEHRKNITVAELKRVGLVAKVIPLFFSEEYKDSVQPFYN<br>YLFNVGNINKPDEKNFLNCEERRELLRKKKDEFKKMTDKEKEE<br>NPSYLEFQSWNKFERELRLVRNQDIVTWLLCMELFNKKKIKEL<br>NVEKIYLKNINTNTTKKEKNTEEKNGEEKIIKEKNNILNRIMPMR<br>LPIKVYGRENFSKNKKKKIRRNTFFTVYIEEKGTKLLKQGNFKA<br>LERDRRLGGLFSFVKTHSKAESKSNTISKSRVEYELGEYQKARIE<br>IIKDMLALEETLIDKYNSLDTDNFHNMLTGWLKLKDEPDKASF<br>QNDVDLLIAVRNAFSHNQYPMRNRIAFANINPFSLSSANTSEEK<br>GLGIANQLKDKTHKTIEKIIEIEKPIETKE |
| *Myroides odoratimimus* | WP_006261414 (SEQ ID NO: 144) | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSEIVIENKVLDFLNSSLVSTALHVKDKYLKTDKTKE<br>FLKETIAAELDILIEAYKKKQIEKKNTRFKANKREDILNAIYNEA<br>FWSFINDKDKDKETVVAKGADAYFEKNHHKSNDPDFALNISEK<br>GIVYLLSFFLTNKEMDSLKANLTGFKGKVDRESGNSIKYMATQ<br>RIYSFHTYRGLKQKIRTSEEGVKETLLMQMIDELSKVPNVVYQH<br>LSTTQQNSFIEDWNEYYKDYEDDVETDDLSRVIHPVIRKRYEDR<br>FNYFAIRFLDEFFDFPTLRFQVHLGDYVHDRRTKQLGKVESDRII<br>KEKVTVFARLKDINSAKANYFHSLEEQDKEELDNKWTLFPNPS<br>YDFPKEHTLQHQGEQKNAGKIGIYVKLRDTQYKEKAALEEARK<br>SLNPKERSATKASKYDIITQIIEANDNVKSEKPLVFTGQPIAYLS<br>MNDIHSMLFSLLTDNAELKKTPEEVEAKLIDQIGKQINEILSKDT<br>DTKILKKYKDNDLKETDTDKITRDLARDKEEIEKLILEQKQRAD<br>DYNYTSSTKFNIDKSRKRKHLLFNAEKGKIGVWLANDIKRFMT<br>EEFKSKWKGYQHTELQKLFAYYDTSKSDLDLILSDMVMVKDY<br>PIELIALVKKSRTLVDFLNKYLEARLGYMENVITRVKNSIGTPQF<br>KTVRKECFTFLKKSNYTVVSLDKQVERILSMPLFIERGFMDDKP<br>TMLEGKSYQQHKEKFADWFVHYKENSNYQNFYDTEVYEITTE<br>DKREKAKVTKKIKQQQKNDVFTLMMVNYMLEEVLKLSSNDRL<br>SLNELYQTKEERIVNKQVAKDTQERNKNYIWNKVVDLQLCEG<br>LVRIDKVKLKDIGNFRKYENDSRVKEFLTYQSDIVWSAYLSNEV<br>DSNKLYVIERQLDNYESIRSKELLKEVQEIECSVYNQVANKESL<br>KQSGNENFKQYVLQGLVPIGMDVREMLILSTDVKFIKEEIIQLG<br>QAGEVEQDLYSLIYIRNKFAHNQLPIKEFFDFCENNYRSISDNEY<br>YAEYYMEIFRSIKEKYTS |
| *Myroides odoratimimus* | WP_006265509 (SEQ ID NO: 145) | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSEIVIENKVLDFLNSSLVSTALHVKDKYLKTDKTKE<br>FLKETIAAELDILIEAYKKKQIEKKNTRFKANKREDILNAIYNEA<br>FWSFINDKDKDKETVVAKGADAYFEKNHHKSNDPDFALNISEK |

TABLE 3-continued

| | | |
|---|---|---|
| | | GIVYLLSFFLTNKEMDSLKANLTGFKGKVDRESGNSIKYMATQ<br>RIYSFHTYRGLKQKIRTSEEGVKETLLMQMIDELSKVPNVVYQH<br>LSTTQQNSFIEDWNEYYKDYEDDVETDDLSRVIHPVIRKRYEDR<br>FNYFAIRFLDEFFDFPTLRFQVHLGDYVHDRRTKQLGKVESDRII<br>KEKVTVFARLKDINSAKASYFHSLEEQDKEELDNKWTLFPNPS<br>YDFPKEHTLQHQGEQKNAGKIGIYVKLRDTQYKEKAALEEARK<br>SLNPKERSATKASKYDIITQIIEANDNVKSEKPLVFTGQPIAYLS<br>MNDIHSMLFSLLTDNAELKKTPEEVEAKLIDQIGKQINEILSKDT<br>DTKILKKYKDNDLKETDTDKITRDLARDKEEIEKLILEQKQRAD<br>DYNYTSSTKFNIDKSRKRKHLLFNAEKGKIGVWLANDIKRFMF<br>KESKSKWKGYQHTELQKLFAYFDTSKSDLELILSDMVMVKDYP<br>IELIDLVRKSRTLVDFLNKYLEARLGYIENVITRVKNSIGTPQFKT<br>VRKECFAFLKESNYTVASLDKQIERILSMPLFIERGFMDSKPTML<br>EGKSYQQHKEDFADWFVHYKENSNYQNFYDTEVYEIITEDKRE<br>QAKVTKKIKQQQKNDVFTLMMVNYMLEEVLKLPSNDRLSLNE<br>LYQTKEERIVNKQVAKDTQERNKNYIWNKVVDLQLCEGLVRID<br>KVKLKDIGNFRKYENDSRVKEFLTYQSDIVWSGYLSNEVDSNK<br>LYVIERQLDNYESIRSKELLKEVQEIECIVYNQVANKESLKQSGN<br>ENFKQYVLQGLLPRGTDVREMLILSTDVKFKKEEIMQLGQVRE<br>VEQDLYSLIYIRNKFAHNQLPIKEFFDFCENNYRPISDNEYYAEY<br>YMEIFRSIKEKYAS |
| *Prevotella* sp. MSX73 | WP_007412163 (SEQ ID NO: 146) | MQKQDKLFVDRKKNAIFAFPKYITIMENQEKPEPIYYELTDKHF<br>WAAFLNLARHNVYTTINHINRRLEIAELKDDGYMMGIKGSWNE<br>QAKKLDKKVRLRDLIMKHFPFLEAAAYEITNSKSPNNKEQREK<br>EQSEALSLNNLKNVLFIFLEKLQVLRNYYSHYKYSEESPKPIFET<br>SLLKNMYKVFDANVRLVKRDYMHHENIDMQRDFTHLNRKKQ<br>VGRTKNIIDSPNFHYHFADKEGNMTIAGLLFFVSLFLDKKDAIW<br>MQKKLKGFKDGRNLREQMTNEVFCRSRISLPKLKLENVQTKD<br>WMQLDMLNELVRCPKSLYERLREKDRESFKVPFDIFSDDYDAE<br>EEPFKNTLVRHQDRFPYFVLRYFDLNEIFEQLRFQIDLGTYHFSI<br>YNKRIGDEDEVRHLTHHLYGFARIQDFAPQNQPEEWRKLVKDL<br>DHFETSQEPYISKTAPHYHLENEKIGIKFCSTHNNLFPSLKREKT<br>CNGRSKFNLGTQFTAEAFLSVHELLPMMFYYLLLTKDYSRKES<br>ADKVEGIIRKEISNIYAIYDAFANNEINSIADLTCRLQKTNILQGH<br>LPKQMISILEGRQKDMEKEAERKIGEMIDDTQRRLDLLCKQTNQ<br>KIRIGKRNAGLLKSGKIADWLVSDMMRFQPVQKDTNNAPINNS<br>KANSTEYRMLQHALALFGSESSRLKAYFRQMNLVGNANPHPFL<br>AETQWEHQTNILSFYRNYLEARKKYLKGLKPQNWKQYQHFLIL<br>KVQKTNRNTLVTGWKNSFNLPRGIFTQPIREWFEKHNNSKRIYD<br>QILSFDRVGFVAKAIPLYFAEEYKDNVQPFYDYPFNIGNKLKPQ<br>KGQFLDKKERVELWQKNKELFKNYPSEKNKTDLAYLDFLSWK<br>KFERELRLIKNQDIVTWLMFKELFKTTTVEGLKIGEIHLRDIDTN<br>TANEESNNILNRIMPMKLPVKTYETDNKGNILKERPLATFYIEET<br>ETKVLKQGNFKVLAKDRRLNGLLSFAETTDIDLEKNPITKLSVD<br>YELIKYQTTRISIFEMTLGLEKKLIDKYSTLPTDSFRNMLERWLQ<br>CKANRPELKNYVNSLIAVRNAFSHNQYPMYDATLFAEVKKFTL<br>FPSVDTKKIELNIAPQLLEIVGKAIKEIEKSENKN |
| *Porphyromonas gingivalis* | WP_012458414 (SEQ ID NO: 147) | MTEQNERPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRYGNNDN<br>PFFKHHFVDREEKVTEAGLLFFVSLFLEKRDAIWMQKKIRGFKG<br>GTETYQQMTNEVFCRSRISLPKLKLESLRTDDWMLLDMLNELV<br>RCPKSLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQHLWPSPEVGATRTGRSKY<br>AQDKRLTAEAFLSVHELMPMMFYYFLLREKYSDEASAERVQG<br>RIKRVIEDVYAVYDAFARGEINTRDELDACLADKGIRRGHLPRQ<br>MIGILSQEHKDMEEKVRKKLQEMIVDTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDRVENHRFLLLKEP<br>KTDRQTLVAGWKGEFHLPRGIFTEAVRDCLIEMGLDEVGSYKE<br>VGFMAKAVPLYFERACKDRVQPFYDYPFNVGNSLKPKKGRFLS<br>KEKRAEEWESGKERFRLAKLKKEILEAKEHPYLDFKSWQKFER<br>ELRLVKNQDIITWMICRDLMEENKVEGLDTGTLYLKDIRTDVQ<br>EQGNLNVLNRVKPMRLPVVVYRADSRGHVHKEQAPLATVYIE<br>ERDTKLLKQGNFKSFVKDRRLNGLFSFVDTGALAMEQYPISKL<br>RVEYELAKYQTARVCAFEQTLELEESLLTRYPHLPDKNFRKML<br>ESWSDPLLDKWPDLHGNVRLLIAVRNAFSHNQYPMYDEAVFSS<br>IRKYDPSSPDAIEERMGLNIAHRLSEEVKQAKEMAERIIQA |
| *Paludibacter propionicigenes* | WP_013446107 (SEQ ID NO: 148) | MKTSANNIYFNGINSFKKIFDSKGAIAPIAEKSCRNFDIKAQNDV<br>NKEQRIHYFAVGHTFKQLDTENLFEYVLDENLRAKRPTRFISLQ<br>QFDKEFIENIKRLISDIRNINSHYIHRFDPLKIDAVPTNIIDFLKESF<br>ELAVIQIYLKEKGINYLQFSENPHADQKLVAFLHDKFLPLDEKK |

TABLE 3-continued

| | | |
|---|---|---|
| | | TSMLQNETPQLKEYKEYRKYFKTLSKQAAIDQLLFAEKETDYI<br>WNLFDSHPVLTISAGKYLSFYSCLFLLSMFLYKSEANQLISKIKG<br>FKKNTTEEEKSKREIFTFFSKRFNSMDIDSEENQLVKFRDLILYL<br>NHYPVAWNKDLELDSSNPAMTDKLKSKIIELEINRSFPLYEGNE<br>RFATFAKYQIWGKKHLGKSIEKEYINASFTDEEITAYTYETDTCP<br>ELKDAHKKLADLKAAKGLFGKRKEKNESDIKKTETSIRELQHEP<br>NPIKDKLIQRIEKNLLTVSYGRNQDRFMDFSARFLAEINYFGQD<br>ASFKMYHFYATDEQNSELEKYELPKDKKKYDSLKFHQGKLVH<br>FISYKEHLKRYESWDDAFVIENNAIQLKLSFDGVENTVTIQRAL<br>LIYLLEDALRNIQNNTAENAGKQLLQEYYSHNKADLSAFKQILT<br>QQDSIEPQQKTEFKKLLPRRLLNNYSPAINHLQTPHSSLPLILEK<br>ALLAEKRYCSLVVKAKAEGNYDDFIKRNKGKQFKLQFIRKAW<br>NLMYFRNSYLQNVQAAGHHKSFHIERDEFNDFSRYMFAFEELS<br>QYKYYLNEMFEKKGFFENNEFKILFQSGTSLENLYEKTKQKFEI<br>WLASNTAKTNKPDNYHLNNYEQQFSNQLFFINLSHFINYLKSTG<br>KLQTDANGQIIYEALNNVQYLIPEYYYTDKPERSESKSGNKLYN<br>KLKATKLEDALLYEMAMCYLKADKQIADKAKHPITKLLTSDVE<br>FNITNKEGIQLYHLLVPFKKIDAFIGLKMHKEQQDKKHPTSFLA<br>NIVNYLELVKNDKDIRKTYEAFSTNPVKRTLTYDDLAKIDGHLI<br>SKSIKFTNVTLELERYFIFKESLIVKKGNNIDFKYIKGLRNYYNN<br>EKKKNEGIRNKAFHFGIPDSKSYDQLIRDAEVMFIANEVKPTHA<br>TKYTDLNKQLHTVCDKLMETVHNDYFSKEGDGKKKREAAGQ<br>KYFENIISAK |
| *Porphyromonas gingivalis* | WP_013816155 (SEQ ID NO: 149) | MTEQNEKPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKNKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRYGNNDN<br>PFFKHHFVDREGTVTEAGLLFFVSLFLEKRDAIWMQKKIRGFKG<br>GTETYQQMTNEVFCRSRISLPKLKLESLRTDDWMLLDMLNELV<br>RCPKSLYDRLREEDRARFRVPVDILSDEEDTDGAEEDPFKNTLV<br>RHQDRFPYFALRYFDLKKVFTSLRFQIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQHLWPSPEVGATRTGRSKY<br>AQDKRFTAEAFLSAHELMPMMFYYFLLREKYSEEASAERVQGR<br>IKRVIEDVYAVYDAFARDEINTRDELDACLADKGIRRGHLPRQ<br>MIGILSQEHKDMEEKIRKKLQEMMADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDRVENHRFLLLKEP<br>KTDRQTLVAGWKGEFHLPRGIFTEAVRDCLIEMGLDEVGSYKE<br>VGFMAKAVPLYFERACKDWVQPFYNYPFNVGNSLKPKKGRFL<br>SKEKRAEEWESGKERFRLAKLKKEILEAKEHPYLDFKSWQKFE<br>RELRLVKNQDIITWMICGDLMEENKVEGLDTGTLYLKDIRTDV<br>QEQGSLNVLNRVKPMRLPVVVYRADSRGHVHKEQAPLATVYI<br>EERDTKLLKQGNFKSFVKDRRLNGLFSFVDTGALAMEQYPISK<br>LRVEYELAKYQTARVCAFEQTLELEESLLTRCPHLPDKNFRKM<br>LESWSDPLLDKWPDLHRKVRLLIAVRNAFSHNQYPMYDEAVFS<br>SIRKYDPSFPDAIEERMGLNIAHRLSEEVKQAKETVERIIQA |
| *Flavobacterium columnare* | WP_014165541 (SEQ ID NO: 150) | MSSKNESYNKQKTFNHYKQEDKYFFGGFLNNADDNLRQVGKE<br>FKTRINFNHNNNELASVFKDYFNKEKSVAKREHALNLLSNYFP<br>VLERIQKHTNHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLRPFLEENKTDDKQNKT<br>VSLRKYRKSKPNEETSITLTQSGLVFLMSFFLHRKEFQVFTSGLE<br>GFKAKVNTIKEEEISLNKNNIVYMITHWSYSYYNFKGLKHRIKT<br>DQGVSTLEQNNTTHSLTNTNTKEALLTQIVDYLSKVPNEIYETL<br>SEKQQKEFEEDINEYMRENPENEDSTESSIVSHKVIRKRYENKFN<br>YFAMRFLDEYAELPTLRFMVNFGDYIKDRQKKILESIQFDSERII<br>KKEIHLFEKLSLVTEYKKNVYLKETSNIDLSRFPLFPNPSYVMA<br>NNNIPFYIDSRSNNLDEYLNQKKKAQSQNKKRNLTFEKYNKEQ<br>SKDAIIAMLQKEIGVKDLQQRSTIGLLSCNELPSMLYEVIVKDIK<br>GAELENKIAQKIREQYQSIRDFTLDSPQKDNIPTTLIKTINTDSSV<br>TFENQPIDIPRLKNAIQKELTLTQEKLLNVKEHEIEVDNYNRNKN<br>TYKFKNQPKNKVDDKKLQRKYVFYRNEIRQEANWLASDLIHF<br>MKNKSLWKGYMHNELQSFLAFFEDKKNDCIALLETVFNLKED<br>CILTKGLKNLFLKHGNFIDFYKEYLKLKEDFLNTESTFLENGLIG<br>LPPKILKKELSKRFKYIFIVFQKRQFIIKELEEKKNNLYADAINLS<br>RGIFDEKPTMIPFKKPNPDEFASWFVASYQYNNYQSFYELTPDI<br>VERDKKKKYKNLRAINKVKIQDYYLKLMVDTLYQDLFNQPLD<br>KSLSDFYVSKAEREKIKADAKAYQKRNDSSLWNKVIHLSLQNN<br>RITANPKLKDIGKYKRALQDEKIATLLTYDDRTWTYALQKPEK<br>ENENDYKELHYTALNMELQEYEKVRSKELLKQVQELEKQILEE<br>YTDFLSTQIHPADFEREGNPNFKKYLAHSILENEDDLDKLPEKV<br>EAMRELDETITNPIIKKAIVLIIIRNKMAHNQYPPKFIYDLANRFV<br>PKKEEEYFATYFNRVFETITKELWENKEKKDKTQV |

TABLE 3-continued

| | | |
|---|---|---|
| *Psychroflexus torquis* | WP_015024765 (SEQ ID NO: 151) | MESIIGLGLSFNPYKTADKHYFGSFLNLVENNLNAVFAEFKERIS<br>YKAKDENISSLIEKHFIDNMSIVDYEKKISILNGYLPIIDFLDDELE<br>NNLNTRVKNFKKNFIILAEAIEKLRDYYTHFYHDPITFEDNKEPL<br>LELLDEVLLKTILDVKKKYLKTDKTKEILKDSLREEMDLLVIRK<br>TDELREKKKTNPKIQHTDSSQIKNSIFNDAFQGLLYEDKGNNKK<br>TQVSHRAKTRLNPKDIHKQEERDFEIPLSTSGLVFLMSLFLSKKE<br>IEDFKSNIKGFKGKVVKDENHNSLKYMATHRVYSILAFKGLKY<br>RIKTDTFSKETLMMQMIDELSKVPDCVYQNLSETKQKDFIEDW<br>NEYFKDNEENTENLENSRVVHPVIRKRYEDKFNYFAIRFLDEFA<br>NFKTLKFQVFMGYYIHDQRIKTIGTTNITTERTVKEKINVFGKL<br>SKMDNLKKHFFSQLSDDENTDWEFFPNPSYNFLTQADNSPANN<br>IPIYLELKNQQIIKEKDAIKAEVNQTQNRNPNKPSKRDLLNKILK<br>TYEDFHQGDPTAILSLNEIPALLHLFLVKPNNKTGQQIENIIRIKIE<br>KQFKAINHPSKNNKGIPKSLFADTNVRVNAIKLKKDLEAELDM<br>LNKKHIAFKENQKASSNYDKLLKEHQFTPKNKRPELRKYVFYK<br>SEKGEEATWLANDIKRFMPKDFKTKWKGCQHSELQRKLAFYD<br>RHTKQDIKELLSGCEFDHSLLDINAYFQKDNFEDFFSKYLENRIE<br>TLEGVLKKLHDFKNEPTPLKGVFKNCFKFLKRQNYVTESPEIIK<br>KRILAKPTFLPRGVFDERPTMKKGKNPLKDKNEFAEWFVEYLE<br>NKDYQKFYNAEEYRMRDADFKKNAVIKKQKLKDFYTLQMVN<br>YLLKEVFGKDEMNLQLSELFQTRQERLKLQGIAKKQMNKETG<br>DSSENTRNQTYIWNKDVPVSFFNGKVTIDKVKLKNIGKYKRYE<br>RDERVKTFIGYEVDEKWMMYLPHNWKDRYSVKPINVIDLQIQE<br>YEEIRSHELLKEIQNLEQYIYDHTTDKNILLQDGNPNFKMYVLN<br>GLLIGIKQVNIPDFIVLKQNTNEDKIDFTGIASCSELEKKTIILIAIR<br>NKFAHNQLPNKMIYDLANEFLKIEKNETYANYYLKVLKKMISD<br>LA |
| *Riemerella anatipestifer* | WP_015345620 (SEQ ID NO: 152) | MFFSFHNAQRVIFKHLYKAFDASLRMVKEDYKAHFTVNLTRDF<br>AHLNRKGKNKQDNPDFNRYRFEKDGFFTESGLLFFTNLFLDKR<br>DAYWMLKKVSGFKASHKQREKMTTEVFCRSRILLPKLRLESRY<br>DHNQMLLDMLSELSRCPKLLYEKLSEENKKHFQVEADGFLDEI<br>EEEQNPFKDTLIRHQDRFPYFALRYLDLNESFKSIRFQVDLGTYH<br>YCIYDKKIGDEQEKRHLTRTLLSFGRLQDFTEINRPQEWKALTK<br>DLDYKETSNQPFISKTTPHYHITDNKIGFRLGTSKELYPSLEIKDG<br>ANRIAKYPYNSGFVAHAFISVHELLPLMFYQHLTGKSEDLLKET<br>VRHIQRIYKDFEEERINTIEDLEKANQGRLPLGAFPKQMLGLLQ<br>NKQPDLSEKAKIKIEKLIAETKLLSHRLNTKLKSSPKLGKRREKL<br>IKTGVLADWLVKDFMRFQPVAYDAQNQPIKSSKANSTEFWFIR<br>RALALYGGEKNRLEGYFKQTNLIGNTNPHPFLNKFNWKACRNL<br>VDFYQQYLEQREKFLEAIKHQPWEPYQYCLLLKVPKENRKNLV<br>KGWEQGGISLPRGLFTEAIRETLSKDLTLSKPIRKEIKKHGRVGFI<br>SRAITLYFKEKYQDKHQSFYNLSYKLEAKAPLLKKEEHYEYWQ<br>QNKPQSPTESQRLELHTSDRWKDYLLYKRWQHLEKKLRLYRN<br>QDIMLWLMTLELTKNHFKELNLNYHQLKLENLAVNVQEADAK<br>LNPLNQTLPMVLPVKVYPTTAFGEVQYHETPIRTVYIREEQTKA<br>LKMGNFKALVKDRRLNGLFSFIKEENDTQKHPISQLRLRRELEI<br>YQSLRVDAFKETLSLEEKLLNKHASLSSLENEFRTLLEEWKKKY<br>AASSMVTDKHIAFIASVRNAFCHNQYPFYKETLHAPILLFTVAQ<br>PTTEEKDGLGIAEALLKVLREYCEIVKSQI |
| *Prevotella pleuritidis* | WP_021584635 (SEQ ID NO: 153) | MENDKRLEESACYTLNDKHFWAAFLNLARHNVYITVNHINKTL<br>ELKNKKNQEIIIDNDQDILAIKTHWAKVNGDLNKTDRLRELMIK<br>HFPFLEAAIYSNNKEDKEEVKEEKQAKAQSFKSLKDCLFLFLEK<br>LQEARNYYSHYKYSESSKEPEFEEGLLEKMYNTFDASIRLVKED<br>YQYNKDIDPEKDFKHLERKEDFNYLFTDKDNKGKITKNGLLFF<br>VSLFLEKKDAIWMQQKFRGFKDNRGNKEKMTHEVFCRSRMLL<br>PKIRLESTQTQDWILLDMLNELIRCPKSLYERLQGAYREKFKVP<br>FDSIDEDYDAEQEPFRNTLVRHQDRFPYFALRYFDYNEIFKNLR<br>FQIDLGTYHFSIYKKLIGGKKEDRHLTHKLYGFERIQEFTKQNRP<br>DKWQAIIKDLDTYETSNERYISETTPHYHLENQKIGIRFRNDNN<br>DIWPSLKTNGEKNEKSKYNLDKPYQAEAFLSVHELLPMMFYYL<br>LLKMENTDNDKEDNEVGTKKKGNKNNKQEKHKIEEIIENKIKDI<br>YALYDAFTNGEINSIDELAEQREGKDIEIGHLPKQLIVILKNKSK<br>DMAEKANRKQKEMIKDTKKRLATLDKQVKGEIEDGGRNIRLL<br>KSGEIARWLVNDMMRFQPVQKDNEGKPLNNSKANSTEYQMLQ<br>RSLALYNKEEKPTRYFRQVNLIKSSNPHPFLEDTKWEECYNILSF<br>YRNYLKAKIKFLNKLKPEDWKKNQYFLMLKEPKTNRKTLVQG<br>WKNGFNLPRGIFTEPIKEWFKRHQNDSEEYKKVEALDRVGLVA<br>KVIPLFFKEEYFKEDAQKEINNCVQPFYSFPYNVGNIHKPEEKNF<br>LHCEERRKLWDKKKDKFKGYKAKEKSKKMTDKEKEEHRSYLE<br>FQSWNKFERELRLVRNQDILTWLLCTKLIDKLKIDELNIEELQKL<br>RLKDIDTDTAKKEKNNILNRVMPMRLPVTVYEIDKSFNIVKDKP<br>LHTVYIEETGTKLLKQGNFKALVKDRRLNGLFSFVKTSSEAESK<br>SKPISKLRVEYELGAYQKARIDIIKDMLALEKTLIDNDENLPTNK<br>FSDMLKSWLKGKGEANKARLQNDVGLLVAVRNAFSHNQYPM<br>YNSEVFKGMKLLSLSSDIPEKEGLGIAKQLKDKIKETIERIIEIEKE<br>IRN |

TABLE 3-continued

| | | |
|---|---|---|
| *Porphyromonas gingivalis* | WP_021663197 (SEQ ID NO: 154) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| *Porphyromonas gingivalis* | WP_021665475 (SEQ ID NO: 155) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTNENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |
| *Porphyromonas gingivalis* | WP_021677657 (SEQ ID NO: 156) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |

TABLE 3-continued

| | | |
|---|---|---|
| *Porphyromonas gingivalis* | WP_021680012 (SEQ ID NO: 157) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIHGKSVSYIPSDGKKFADCYTHL<br>MEKTVRDKKRELRTAGKPVPPDLAAYIKRSFHRAVNEREFMLR<br>LVQEDDRLMLMAINKIMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEIPLIYRDVSAKVGSIEGSSAKDLPEG<br>SSLVDSLWKKYEMIIRKILPILDPENRFFGKLLNNMSQPINDL |
| *Porphyromonas gingivalis* | WP_023846767 (SEQ ID NO: 158) | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| *Prevotella falsenii* | WP_036884929 (SEQ ID NO: 159) | MKNDNNSTKSTDYTLGDKHFWAAFLNLARHNVYITVNHINKV<br>LELKNKKDQEIIIDNDQDILAIKTLWGKVDTDINKKDRLRELIM<br>KHFPFLEAATYQQSSTNNTKQKEEEQAKAQSFESLKDCLFLFLE<br>KLREARNYYSHYKHSKSLEEPKLEEKLLENMYNIFDTNVQLVIK<br>DYEHNKDINPEEDFKHLGRAEGEFNYYFTRNKKGNITESGLLFF<br>VSLFLEKKDAIWAQTKIKGFKDNRENKQKMTHEVFCRSRMLLP<br>KLRLESTQTQDWILLDMLNELIRCPKSLYKRLQGEKREKFRVPF<br>DPADEDYDAEQEPFKNTLVRHQDRFPYFALRYFDYNEIFTNLRF<br>QIDLGTYHFSIYKKQIGDKKEDRHLTHKLYGFERIQEFAKENRP<br>DEWKALVKDLDTFEESNEPYISETTPHYHLENQKIGIRNKNKKK<br>KKTIWPSLETKTTVNERSKYNLGKSFKAEAFLSVHELLPMMFY<br>YLLLNKEEPNNGKINASKVEGIIEKKIRDIYKLYGAFANEEINNE<br>EELKEYCEGKDIAIRHLPKQMIAILKNEYKDMAKKAEDKQKKM<br>IKDTKKRLAALDKQVKGEVEDGGRNIKPLKSGRIASWLVNDM<br>MRFQPVQRDRDGYPLNNSKANSTEYQLLQRTLALFGSERERLA<br>PYFRQMNLIGKDNPHPFLKDTKWKEHNNILSFYRSYLEAKKNF<br>LGSLKPEDWKKNQYFLKLKEPKTNRETLVQGWKNGFNLPRGIF<br>TEPIREWFIRHQNESEEYKKVKDFDRIGLVAKVIPLFFKEDYQKE<br>IEDYVQPFYGYPFNVGNIHNSQEGTFLNKKEREELWKGNKTKF<br>KDYKTKEKNKEKTNKDKFKKKTDEEKEEFRSYLDFQSWKKFE<br>RELRLVRNQDIVTWLLCMELIDKLKIDELNIEELQKLRLKDIDTD<br>TAKKEKNNILNRIMPMELPVTVYETDDSNNIIKDKPLHTIYIKEA<br>ETKLLKQGNFKALVKDRRLNGLFSFVETSSEAELKSKPISKSLVE |

TABLE 3-continued

| | | |
|---|---|---|
| | | YELGEYQRARVEIIKDMLRLEETLIGNDEKLPTNKFRQMLDKW<br>LEHKKETDDTDLKNDVKLLTEVRNAFSHNQYPMRDRIAFANIK<br>PFSLSSANTSNEEGLGIAKKLKDKTKETIDRIIEIEEQTATKR |
| *Prevotella pleuritidis* | WP_036931485 (SEQ ID NO: 160) | MENDKRLEESTCYTLNDKHFWAAFLNLARHNVYITINHINKLL<br>EIRQIDNDEKVLDIKALWQKVDKDINQKARLRELMIKHFPFLEA<br>AIYSNNKEDKEEVKEEKQAKAQSFKSLKDCLFLFLEKLQEARN<br>YYSHYKSSESSKEPEFEEGLLEKMYNTFGVSIRLVKEDYQYNKD<br>IDPEKDFKHLERKEDFNYLFTDKDNKGKITKNGLLFFVSLFLEK<br>KDAIWMQQKLRGFKDNRGNKEKMTHEVFCRSRMLLPKIRLES<br>TQTQDWILLDMLNELIRCPKSLYERLQGAYREKFKVPFDSIDED<br>YDAEQEPFRNTLVRHQDRFPYFALRYFDYNEIFKNLRFQIDLGT<br>YHFSIYKKLIGDNKEDRHLTHKLYGFERIQEFAKQKRPNEWQA<br>LVKDLDIYETSNEQYISETTPHYHLENQKIGIRFKNKKDKIWPSL<br>ETNGKENEKSKYNLDKSFQAEAFLSIHELLPMMFYDLLLKKEEP<br>NNDEKNASIVEGFIKKEIKRMYAIYDAFANEEINSKEGLEEYCK<br>NKGFQERHLPKQMIAILTNKSKNMAEKAKRKQKEMIKDTKKR<br>LATLDKQVKGEIEDGGRNIRLLKSGEIARWLVNDMMRFQSVQK<br>DKEGKPLNNSKANSTEYQMLQRSLALYNKEQKPTPYFIQVNLI<br>KSSNPHPFLEETKWEECNNILSFYRSYLEAKKNFLESLKPEDWK<br>KNQYFLMLKEPKTNRKTLVQGWKNGFNLPRGIFTEPIKEWFKR<br>HQNDSEEYKKVEALDRVGLVAKVIPLFFKEEYFKEDAQKEINN<br>CVQPFYSFPYNVGNIHKPEEKNFLHCEERRKLWDKKKDKFKGY<br>KAKEKSKKMTDKEKEEHRSYLEFQSWNKFERELRLVRNQDIVT<br>WLLCTELIDKLKIDELNIEELQKLRLKDIDTDTAKKEKNNILNRI<br>MPMQLPVTVYEIDKSFNIVKDKPLHTIYIEETGTKLLKQGNFKA<br>LVKDRRLNGLFSFVKTSSEAESKSKPISKLRVEYELGAYQKARI<br>DIIKDMLALEKTLIDNDENLPTNKFSDMLKSWLKGKGEANKAR<br>LQNDVDLLVAIRNAFSHNQYPMYNSEVFKGMKLLSLSSDIPEKE<br>GLGIAKQLKDKIKETIERIIEIEKEIRN |
| [*Porphyromonas gingivalis* | WP_039417390 (SEQ ID NO: 161) | MTEQNERPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRYGNNDN<br>PFFKHHFVDREGTVTEAGLLFFVSLFLEKRDAIWMQKKIRGFKG<br>GTEAYQQMTNEVFCRSRISLPKLKLESLRTDDWMLLDMLNELV<br>RCPKSLYDRLREEDRARFRVPIDILSDEDDTDGTEEDPFKNTLVR<br>HQDRFPYFALRYFDLKKVFTSLRFHIDLGTYHFAIYKKNIGEQPE<br>DRHLTRNLYGFGRIQDFAEEHRPEEWKRLVRDLDYFETGDKPY<br>ITQTTPHYHIEKGKIGLRFVPEGQHLWPSPEVGATRTGRSKYAQ<br>DKRLTAEAFLSVHELMPMMFYYFLLREKYSEEVSAEKVQGRIK<br>RVIEDVYAVYDAFARGEIDTLDRLDACLADKGIRRGHLPRQMI<br>AILSQEHKDMEEKVRKKLQEMIADTDHRLDMLDRQTDRKIRIG<br>RKNAGLPKSGVIADWLVRDMMRFQPVAKDTSGKPLNNSKANS<br>TEYRMLQRALALFGGEKERLTPYFRQMNLTGGNNPHPFLHETR<br>WESHTNILSFYRSYLKARKAFLQSIGRSDREENHRFLLLKEPKT<br>DRQTLVAGWKSEFHLPRGIFTEAVRDCLIEMGYDEVGSYKEVG<br>FMAKAVPLYFERACKDRVQPFYDYPFNVGNSLKPKKGRFLSKE<br>KRAEEWESGKERFRLAKLKKEILEAKEHPYLDFKSWQKFEREL<br>RLVKNQDIITWMMCRDLMEENKVEGLDTGTLYLKDIRTDVHE<br>QGSLNVLNRVKPMRLPVVVYRADSRGHVHKEQAPLATVYIEE<br>RDTKLLKQGNFKSFVKDRRLNGLFSFVDTGALAMEQYPISKLR<br>VEYELAKYQTARVCAFEQTLELEESLLTRYPHLPDKNFRKMLE<br>SWSDPLLDKWPDLHRKVRLLIAVRNAFSHNQYPMYDEAVFSSI<br>RKYDPSSPDAIEERMGLNIAHRLSEEVKQAKEMAERIIQV |
| *Porphyromonas gulae* | WP_039418912 (SEQ ID NO: 162) | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRMDDWMLLDMLNE<br>LVRCPKPLYDRLREDDRACFRVPVDILPDEDDTDGGGEDPFKN<br>TLVRHQDRFPYFALRYFDLKKVFTSLRFHIDLGTYHFAIYKKMI<br>GEQPEDRHLTRNLYGFGRIQDFAEEHRPEEWKRLVRDLDYFET<br>GDKPYISQTSPHYHIEKGKIGLRFMPEGQHLWPSPEVGTTRTGR<br>SKYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKNMEEKVRKKLQEMIADTDHRLDMLDRQTDR<br>KIRIGRKNAGLPKSGVIADWLVRDMMRFQPVAKDASGKPLNNS<br>KANSTEYRMLQRALALFGGEKERLTPYFRQMNLTGGNNPHPFL<br>HDTRWESHTNILSFYRSYLRARKAFLERIGRSDRMENRPFLLLK<br>EPKTDRQTLVAGWKSEFHLPRGIFTEAVRDCLIEMGYDEVGSY<br>REVGFMAKAVPLYFERACEDRVQPFYDSPFNVGNSLKPKKGRF<br>LSKEERAEEWERGKERFRDLEAWSHSAARRIEDAFAGIEYASPG<br>NKKKIEQLLRDLSLWEAFESKLKVRADKINLAKLKKEILEAQEH<br>PYHDFKSWQKFERELRLVKNQDIITWMMCRDLMEENKVEGLD |

TABLE 3-continued

| | | |
|---|---|---|
| | | TGTLYLKDIRTNVQEQGSLNVLNHVKPMRLPVVVYRADSRGH<br>VHKEEAPLATVYIEERDTKLLKQGNFKSFVKDRRLNGLFSFVDT<br>GGLAMEQYPISKLRVEYELAKYQTARVCAFEQTLELEESLLTRY<br>PHLPDKNFRKMLESWSDPLLAKWPELHGKVRLLIAVRNAFSHN<br>QYPMYDEAVESSIRKYDPSSPDAIEERMGLNIAHRLSEEVKQAK<br>ETVERIIQA |
| *Porphyromonas gulae* | WP_039419792 (SEQ ID NO: 163) | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHRHFNHLVRKGKKDRYGHNDN<br>PSFKHHFVDGEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREKDRARFRVPVDILPDEDDTDGGGEDPFKNT<br>LVRHQDRFPYFALRYFDLKKVFTSLRFHIDLGTYHFAIYKKVIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ<br>GRIKRVIEDVYAIYDAFARDEINTRDELDACLADKGIRRGHLPK<br>QMIGILSQEHKNMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLD<br>ETRWESHTNILSFYRSYLRARKAFLERIGRSDRVENRPFLLLKEP<br>KTDRQTLVAGWKSEFHLPRGIFTEAVRDCLIEMGYDEVGSYKE<br>VGFMAKAVPLYFERACKDRVQPFYDSPFNVGNSLKPKKGRFLS<br>KEKRAEEWESGKERFRLAKLKKEILEAQEHPYHDFKSWQKFER<br>ELRLVKNQDIITWMMCRDLMEENKVEGLDTGTLYLKDIRPNVQ<br>EQGSLNVLNRVKPMRLPVVVYRADSRGHVHKEEAPLATVYIEE<br>RDTKLLKQGNFKSFVKDRRLNGLFSFVDTGGLAMEQYPISKLR<br>VEYELAKYQTARVCVFELTLRLEESLLSRYPHLPDESFREMLES<br>WSDPLLAKWPELHGKVRLLIAVRNAFSHNQYPMYDEAVESSIR<br>KYDPSSPDAIEERMGLNIAHRLSEEVKQAKETVERIIQA |
| *Porphyromonas gulae* | WP_039426176 (SEQ ID NO: 164) | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHYHFNHLVRKGKKDRYGHNDN<br>PSFKHHFVDSEGMVTEAGLLFFVSLFLEKRDAIWMQKKIRGFK<br>GGTGPYEQMTNEVFCRSRISLPKLKLESLRTDDWMLLDMLNEL<br>VRCPKPLYDRLREKDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFMPEGQHLWPSPEVGTTRTGRS<br>KYAQDKRLTAEAFLSVHELMPMMFYYFLLREKYSEEVSAEKV<br>QGRIKRVIKDVYAIYDAFARDEINTLKELDACSADKGIRRGHLP<br>KQMIGILSQEHKNMEEKVRKKLQEMIADTDHRLDMLDRQTDR<br>KIRIGRKNAGLPKSGVIADWLVRDMMRFQPVAKDTSGKPLNNS<br>KANSTEYRMLQRALALFGGEKERLTPYFRQMNLTGGNNPHPFL<br>DETRWESHTNILSFYRSYLRARKAFLERIGRSDRVENRPFLLLKE<br>PKNDRQTLVAGWKSEFHLPRGIFTEAVRDCLIEMGYDEVGSYK<br>EVGFMAKAVPLYFERACKDRVQPFYDSPFNVGNSLKPKKGRFL<br>SKEKRAEEWESGKERFRLAKLKKEILEAKEHPYHDFKSWQKFE<br>RELRLVKNQDIITWMMCRDLMEENKVEGLDTGTLYLKDIRTDV<br>HEQGSLNVLNRVKPMRLPVVVYRADSRGHVHKEQAPLATVYI<br>EERDTKLLKQGNFKSFVKDRRLNGLFSFVDTGGLAMEQYPISK<br>LRVEYELAKYQTARVCAFEQTLELEESLLTRYPHLPDENFREML<br>ESWSDPLLGKWPDLHGKVRLLIAVRNAFSHNQYPMYDEAVFSS<br>IRKYDPSSPDAIEERMGLNIAHRLSEEVKQAKETVERIIQA |
| *Porphyromonas gulae* | WP_039431778 (SEQ ID NO: 165) | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN<br>PSFKHHFVDGEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTSPHYHIEKGKIGLRFMPEGQHLWPSPEVGTTRTGRS<br>KYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKDMEEKIRKKLQEMIADTDHRLDMLDRQTDRK<br>IRIGRKNAGLPKSGVIADWLVRDMMRFQPVAKDTSGKPLNNSK<br>ANSTEYRMLQRALALFGGEKKRLTPYFRQMNLTGGNNPHPFLH<br>ETRWESHTNILSFYRSYLRARKAFLERIGRSDRMENRPFLLLKEP<br>KTDRQTLVAGWKSEFHLPRGIFTEAVRDCLIEMGYDEVGSYRE<br>VGFMAKAVPLYFERACEDRVQPFYDSPFNVGNSLKPKKGRFLS |

TABLE 3-continued

| | | |
|---|---|---|
| | | KEERAEEWERGKERFRDLEAWSHSAARRIEDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEEAPLATVYIEERDTKLLKQGNFKSFVKDRRLNGLFSFVDTG<br>GLAMEQYPISKLRVEYELAKYQTARVCVFELTLRLEESLLTRYP<br>HLPDESFRKMLESWSDPLLAKWPELHGKVRLLIAVRNAFSHNQ<br>YPMYDEAVFSSIRKYDPSSPDAIEERMGLNIAHRLSEEVKQAKE<br>TVERIIQV |
| *Porphyromonas gulae* | WP_039437199 (SEQ ID NO: 166) | MTEQSERPYNGTYYTLEDKHFWAAFLNLARHNAYITLTHIDRQ<br>LAYSKADITNDEDILFFKGQWKNLDNDLERKSRLRSLILKHFSF<br>LEGAAYGKKFFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDEVDPHYHFNHLVRKGKKDRYGHNDN<br>PSFKHHFVDGEGMVTEAGLLFFVSLFLEKRDAIWMQKKIRGFK<br>GGTEPYEQMTNEVFCRSRISLPKLKLESLRTDDWMLLDMLNEL<br>VRCPKPLYDRLREKDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ<br>GRIKRVIEDVYAIYDAFARDEINTLKELDACLADKGIRRGHLPK<br>QMIGILSQERKDMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLH<br>ETRWESHTNILSFYRSYLRARKAFLERIGRSDRVENCPFLLLKEP<br>KTDRQTLVAGWKGEFHLPRGIFTEAVRDCLIEMGYDEVGSYRE<br>VGFMAKAVPLYFERACEDRVQPFYDSPFNVGNSLKPKKGRFLS<br>KEKRAEEWESGKERFRLAKLKKEILEAQEHPYHDFKSWQKFER<br>ELRLVKNQDIITWMMCRDLMEENKVEGLDTGTLYLKDIRPNVQ<br>EQGSLNVLNRVKPMRLPVVVYRADSRGHVHKEEAPLATVYIEE<br>RDTKLLKQGNFKSFVKDRRLNGLFSFVDTGALAMEQYPISKLR<br>VEYELAKYQTARVCAFEQTLELEESLLTRYPHLPDESFREMLES<br>WSDPLLTKWPELHGKVRLLIAVRNAFSHNQYPMYDEAVESSIW<br>KYDPSSPDAIEERMGLNIAHRLSEEVKQAKETIERIIQA |
| *Porphyromonas gulae* | WP_039442171 (SEQ ID NO: 167) | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHYHFNHLVRKGKKDRYGHNDN<br>PSFKHHFVDSEGMVTEAGLLFFVSLFLEKRDAIWMQKKIRGFK<br>GGTGPYEQMTNEVFCRSRISLPKLKLESLRTDDWMLLDMLNEL<br>VRCPKPLYDRLREKDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYLETG<br>DKPYISQTTPHYHIEKGKIGLRFVPEGQHLWPSPEVGTTRTGRSK<br>CAQDKRLTAEAFLSVHELMPMMFYYFLLREKYSEEVSAEKVQ<br>GRIKRVIEDVYAIYDAFARDEINTLKELDTCLADKGIRRGHLPK<br>QMITILSQERKDMKEKIRKKLQEMIADTDHRLDMLDRQTDRKI<br>RIGRKNAGLPKSGVIADWLVRDMMRFQPVAKDASGKPLNNSK<br>ANSTEYRMLQRALALFGGEKERLTPYFRQMNLTGGNNPHPFLH<br>ETRWESHTNILSFYRSYLRARKAFLERIGRSDRVENCPFLLLKEP<br>KTDRQTLVAGWKDEFHLPRGIFTEAVRDCLIEMGYDEVGSYRE<br>VGFMAKAVPLYFERACEDRVQPFYDSPFNVGNSLKPKKGRFLS<br>KEDRAEEWERGMERFRDLEAWSHSAARRIKDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEAPLATVYIEERNTKLLKQGNFKSFVKDRRLNGLFSFVDTG<br>GLAMEQYPISKLRVEYELAKYQTARVCVFELTLRLEESLLSRYP<br>HLPDESFREMLESWSDPLLAKWPELHGKVRLLIAVRNAFSHNQ<br>YPMYDEAVFSSIRKYDPSSPDAIEERMGLNIAHRLSEEVKQAKE<br>TVERIIQA |
| *Porphyromonas gulae* | WP_039445055 (SEQ ID NO: 168) | MNTVPATENKGQSRTVEDDPQYFGLYLNLARENLIEVESHVRI<br>KFGKKKLNEESLKQSLLCDHLLSIDRWTKVYGHSRRYLPFLHCF<br>DPDSGIEKDHDSKTGVDPDSAQRLIRELYSLLDFLRNDFSHNRL<br>DGTTFEHLKVSPDISSFITGAYTFACERAQSRFADFFKPDDFLLA<br>KNRKEQLISVADGKECLTVSGFAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS |

TABLE 3-continued

| | | |
|---|---|---|
| | | QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVRDKKRELRTAGKPVPPDLAAYIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |
| *Capnocytophaga cynodegmi* | WP_041989581 (SEQ ID NO: 169) | MENKTSLGNNIYYNPFKPQDKSYFAGYLNAAMENIDSVFRELG<br>KRLKGKEYTSENFFDAIFKENISLVEYERYVKLLSDYFPMARLL<br>DKKEVPIKERKENFKKNFRGIIKAVRDLRNFYTHKEHGEVEITD<br>EIFGVLDEMLKSTVLTVKKKKIKTDKTKEILKKSIEKQLDILCQK<br>KLEYLKDTARKIEEKRRNQRERGEKKLVPRFEYSDRRDDLIAAI<br>YNDAFDVYIDKKKDSLKESSKTKYNTESYPQQEEGDLKIPISKN<br>GVVFLLSLFLSKQEVHAFKSKIAGFKATVIDEATVSHRKNSICF<br>MATHEIFSHLAYKKLKRKVRTAEINYSEAENAEQLSIYAKETLM<br>MQMLDELSKVPDVVYQNLSEDVQKTFIEDWNEYLKENNGDVG<br>TMEEEQVIHPVIRKRYEDKFNYFAIRFLDEFAQFPTLRFQVHLG<br>NYLHDSRPKEHLISDRRIKEKITVFGRLSELEHKKALFIKNTETN<br>EDRKHYWEVFPNPNYDFPKENISVNDKDFPIAGSILDREKQPTA<br>GKIGIKVNLLNQKYISEVDKAVKAHQLKQRNNKPSIQNIIEEIVPI<br>NGSNPKEIIVFGGQPTAYLSMNDIHSILYEFFDKWEKKKEKLEK<br>KGEKELRKEIGKELEEKIVGKIQTQIQQIIDKDINAKILKPYQDDD<br>STAIDKEKLIKDLKQEQKILQKLKNEQTAREKEYQECIAYQEES<br>RKIKRSDKSRQKYLRNQLKRKYPEVPTRKEILYYQEKGKVAVW<br>LANDIKRFMPTDFKNEWKGEQHSLLQKSLAYYEQCKEELKNLL<br>PQQKVFKHLPFELGGHFQQKYLYQFYTRYLDKRLEHISGLVQQ<br>AENFKNENKVFKKVENECFKFLKKQNYTHKGLDAQAQSVLGY<br>PIFLERGFMDEKPTIIKGKTFKGNESLFTDWFRYYKEYQNFQTF<br>YDTENYPLVELEKKQADRKRETKIYQQKKNDVFTLLMAKHIFK<br>SVFKQDSIDRFSLEDLYQSREERLENQEKAKQTGERNTNYIWNK<br>TVDLNLCDGKVTVENVKLKNVGNFIKYEYDQRVQTFLKYEENI<br>KWQAFLIKESKEEENYPYIVEREIEQYEKVRREELLKEVHLIEEY<br>ILEKVKDKEILKKGDNQNFKYYILNGLLKQLKNEDVESYKVFN<br>LNTKPEDVNINQLKQEATDLEQKAFVLTYIRNKFAHNQLPKKEF<br>WDYCQEKYGKIEKEKTYAEYFAEVFKREKEALMK |
| *Prevotella* sp. P5-119 | WP_042518169 (SEQ ID NO: 170) | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLIDGCEFLTSTEQPLSGMISKYYTVALRNTK<br>ERYGYKTEDLAFIQDNIKKITKDAYGKRKSQVNTGFFLSLQDYN<br>GDTQKKLHLSGVGIALLICLFLDKQYINIFLSRLPIFSSYNAQSEE<br>RRIIIRSFGINSIKLPKDRIHSEKSNKSVAMDMLNEVKRCPDELFT<br>TLSAEKQSRFRIISDDHNEVLMKRSTDRFVPLLLQYIDYGKLFD<br>HIRFHVNMGKLRYLLKADKTCIDGQTRVRVIEQPLNGFGRLEE<br>AETMRKQENGTFGNSGIRIRDFENVKRDDANPANYPYIVDTYT<br>HYILENNKVEMFISDKGSSAPLLPLIEDDRYVVKTIPSCRMSTLEI<br>PAMAFHMFLFGSKKTEKLIVDVHNRYKRLFQAMQKEEVTAENI<br>ASFGIAESDLPQKILDLISGNAHGKDVDAFIRLTVDDMLTDTER<br>RIKRFKDDRKSIRSADNKMGKRGFKQISTGKLADFLAKDIVLFQ<br>PSVNDGENKITGLNYRIMQSAIAVYDSGDDYEAKQQFKLMFEK<br>ARLIGKGTTEPHPFLYKVFARSIPANAVDFYERYLIERKFYLTGL<br>CNEIKRGNRVDVPFIRRDQNKWKTPAMKTLGRIYSEDLPVELPR<br>QMFDNEIKSHLKSLPQMEGIDENNANVTYLIAEYMKRVLNDDF<br>QTFYQWKRNYHYMDMLKGEYDRKGSLQHCFTSVEEREGLWK<br>ERASRTERYRKLASNKIRSNRQMRNASSEEIETILDKRLSNCRNE<br>YQKSEKVIRRYRVQDALLFLLAKKTLTELADFDGERFKLKEIMP<br>DAEKGILSEIMPMSFTFEKGGKKYTITSEGMKLKNYGDFFVLAS<br>DKRIGNLLELVGSDIVSKEDIMEEFNKYDQCRPEISSIVFNLEKW<br>AFDTYPELSARVDREEKVDFKSILKILLNNKNINKEQSDILRKIR<br>NAFDHNNYPDKGIVEIKALPEIAMSIKKAFGEYAIMK |
| *Prevotella* sp. P4-76 | WP_044072147 (SEQ ID NO: 171) | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDQASHYKTYDEKLIDGCEFLTSTEQPLSGMINNYYTVALRNM<br>NERYGYKTEDLAFIQDKRFKFVKDAYGKKKSQVNTGFFLSLQD<br>YNGDTQKKLHLSGVGIALLICLFLDKQYINIFLSRLPIFSSYNAQS<br>EERRIIIRSFGINSIKQPKDRIHSEKSNKSVAMDMLNEIKRCPNEL<br>FETLSAEKQSRFRIISNDHNEVLMKRSSDRFVPLLLQYIDYGKLF<br>DHIRFHVNMGKLRYLLKADKTCIDGQTRVRVIEQPLNGFGRLE<br>EVETMRKQENGTFGNSGIRIRDFENMKRDDANPANYPYIVDTY<br>THYILENNKVEMFISDEETPAPLLPVIEDDRYVVKTIPSCRMSTL<br>EIPAMAFHMFLFGSKKTEKLIVDVHNRYKRLFKAMQKEEVTAE |

TABLE 3-continued

| | | |
|---|---|---|
| | | NIASFGIAESDLPQKIIDLISGNAHGKDVDAFIRLTVDDMLADTE<br>RRIKRFKDDRKSIRSADNKMGKRGFKQISTGKLADFLAKDIVLF<br>QPSVNDGENKITGLNYRIMQSAIAVYNSGDDYEAKQQFKLMFE<br>KARLIGKGTTEPHPFLYKVFVRSIPANAVDFYERYLIERKFYLIG<br>LSNEIKKGNRVDVPFIRRDQNKWKTPAMKTLGRIYDEDLPVELP<br>RQMFDNEIKSHLKSLPQMEGIDENNANVTYLIAEYMKRVLNDD<br>FQTFYQWKRNYRYMDMLRGEYDRKGSLQSCFTSVEEREGLWK<br>ERASRTERYRKLASNKIRSNRQMRNASSEEIETILDKRLSNSRNE<br>YQKSEKVIRRYRVQDALLFLLAKKTLTELADFDGERFKLKEIMP<br>DAEKGILSEIMPMSFTFEKGGKKYTITSEGMKLKNYGDFFVLAS<br>DKRIGNLLELVGSDTVSKEDIMEEFKKYDQCRPEISSIVENLEKW<br>AFDTYPELSARVDREEKVDFKSILKILLNNKNINKEQSDILRKIR<br>NAFDHNNYPDKGVVEIRALPEIAMSIKKAFGEYAIMK |
| *Prevotella* sp. P5-60 | WP_044074780 (SEQ ID NO: 172) | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLIDGCEFLTSTEQPFSGMISKYYTVALRNTK<br>ERYGYKAEDLAFIQDNRYKFTKDAYGKRKSQVNTGSFLSLQDY<br>NGDTTKKLHLSGVGIALLICLFLDKQYINLFLSRLPIFSSYNAQSE<br>ERRIIIRSFGINSIKQPKDRIHSEKSNKSVAMDMLNEVKRCPDELF<br>TTLSAEKQSRFRIISDDHNEVLMKRSSDRFVPLLLQYIDYGKLFD<br>HIRFHVNMGKLRYLLKADKTCIDGQTRVRVIEQPLNGFGRLEE<br>VETMRKQENGTFGNSGIRIRDFENMKRDDANPANYPYIVETYT<br>HYILENNKVEMFISDEENPTPLLPVIEDDRYVVKTIPSCRMSTLEI<br>PAMAFHMFLFGSEKTEKLIIDVHDRYKRLFQAMQKEEVTAENI<br>ASFGIAESDLPQKIMDLISGNAHGKDVDAFIRLTVDDMLTDTER<br>RIKRFKDDRKSIRSADNKMGKRGFKQISTGKLADFLAKDIVLFQ<br>PSVNDGENKITGLNYRIMQSAIAVYDSGDDYEAKQQFKLMFEK<br>ARLIGKGTTEPHPFLYKVFVRSIPANAVDFYERYLIERKFYLIGL<br>SNEIKKGNRVDVPFIRRDQNKWKTPAMKTLGRIYSEDLPVELPR<br>QMFDNEIKSHLKSLPQMEGIDENNANVTYLIAEYMKRVLNDDF<br>QTFYQWKRNYRYMDMLRGEYDRKGSLQHCFTSIEEREGLWKE<br>RASRTERYRKLASNKIRSNRQMRNASSEEIETILDKRLSNCRNE<br>YQKSEKIIRRYRVQDALLFLLAKKTLTELADFDGERFKLKEIMP<br>DAEKGILSEIMPMSFTFEKGGKIYTITSGGMKLKNYGDFFVLAS<br>DKRIGNLLELVGSNTVSKEDIMEEFKKYDQCRPEISSIVFNLEKW<br>AFDTYPELPARVDRKEKVDFWSILDVLSNNKDINNEQSYILRKI<br>RNAFDHNNYPDKGIVEIKALPEIAMSIKKAFGEYAIMK |
| *Phaeodactyli-bacter xiamenensis* | WP_044218239 (SEQ ID NO: 173) | MTNTPKRRTLHRHPSYFGAFLNIARHNAFMIMEHLSTKYDMED<br>KNTLDEAQLPNAKLFGCLKKRYGKPDVTEGVSRDLRRYFPFLN<br>YPLFLHLEKQQNAEQAATYDINPEDIEFTLKGFFRLLNQMRNNY<br>SHYISNTDYGKFDKLPVQDIYEAAIFRLLDRGKHTKRFDVFESK<br>HTRHLESNNSEYRPRSLANSPDHENTVAFVTCLFLERKYAFPFL<br>SRLDCFRSTNDAAEGDPLIRKASHECYTMFCCRLPQPKLESSDIL<br>LDMVNELGRCPSALYNLLSEEDQARFHIKREEITGFEEDPDEELE<br>QEIVLKRHSDRFPYFALRYFDDTEAFQTLRFDVYLGRWRTKPV<br>YKKRIYGQERDRVLTQSIRTFTRLSRLLPIYENVKHDAVRQNEE<br>DGKLVNPDVTSQFHKSWIQIESDDRAFLSDRIEHFSPHYNFGDQ<br>VIGLKFINPDRYAAIQNVFPKLPGEEKKDKDAKLVNETADAIIST<br>HEIRSLFLYHYLSKKPISAGDERRFIQVDTETFIKQYIDTIKLFFED<br>IKSGELQPIADPPNYQKNEPLPYVRGDKEKTQEERAQYRERQKE<br>IKERRKELNTLLQNRYGLSIQYIPSRLREYLLGYKKVPYEKLAL<br>QKLRAQRKEVKKRIKDIEKMRTPRVGEQATWLAEDIVFLTPPK<br>MHTPERKTTKHPQKLNNDQFRIMQSSLAYFSVNKKAIKKFFQK<br>ETGIGLSNRETSHPFLYRIDVGRCRGILDFYTGYLKYKMDWLDD<br>AIKKVDNRKHGKKEAKKYEKYLPSSIQHKTPLELDYTRLPVYLP<br>RGLFKKAIVKALAAHADFQVEPEEDNVIFCLDQLLDGDTQDFY<br>NWQRYYRSALTEKETDNQLVLAHPYAEQILGTIKTLEGKQKNN<br>KLGNKAKQKIKDELIDLKRAKRRLLDREQYLRAVQAEDRALW<br>LMIQERQKQKAEHEEIAFDQLDLKNITKILTESIDARLRIPDTKV<br>DITDKLPLRRYGDLRRVAKDRRLVNLASYYHVAGLSEIPYDLV<br>KKELEEYDRRRVAFFEHVYQFEKEVYDRYAAELRNENPKGEST<br>YFSHWEYVAVAVKHSADTHENELFKEKVMQLRNKFHHNEFPY<br>FDWLLPEVEKASAALYADRVEDVAEGYYQKMRKLMRQ |
| *Flavobacterium* sp. 316 | WP_045968377 (SEQ ID NO: 174) | MDNNITVEKTELGLGITYNHDKVEDKHYFGGFFNLAQNNIDLV<br>AQEFKKRLLIQGKDSINIFANYFSDQCSITNLERGIKILAEYFPVV<br>SYIDLDEKNKSKSIREHLILLLETINNLRNYYTHYYHKKIIIDGSL<br>FPLLDTILLKVVLEIKKKKLKEDKTKQLLKKGLEKEMTILFNLM<br>KAEQKEKKIKGWNIDENIKGAVLNRAFSHLLYNDELSDYRKSK<br>YNTEDETLKDTLTESGILFLLSFFLNKKEQEQLKANIKGYKGKIA<br>SIPDEEITLKNNSLRNMATHWTYSHLTYKGLKHRIKTDHEKETL<br>LVNMVDYLSKVPHEIYQNLSEQNKSLFLEDINEYMRDNEENHD<br>SSEASRVIHPVIRKRYENKFAYFAIRFLDEFAEFPTLRFMVNVGN<br>YIHDNRKKDIGGTSLITNRTIKQQINVFGNLTEIHKKKNDYFEKE<br>ENKEKTLEWELFPNPSYHFQKENIPIFIDLEKSKETNDLAKEYAK<br>EKKKIFGSSRKKQQNTAKKNRETIINLVFDKYKTSDRKTVTFEQ<br>PTALLSFNELNSFLYAFLVENKTGKELEKIIIEKIANQYQILKNCS |

TABLE 3-continued

| | | |
|---|---|---|
| | | STVDKTNDNIPKSIKKIVNTTTDSFYFEGKKIDIEKLEKDITIEIEK<br>TNEKLETIKENEESAQNYKRNERNTQKRKLYRKYVFFTNEIGIE<br>ATWITNDILRFLDNKENWKGYQHSELQKFISQYDNYKKEALGL<br>LESEWNLESDAFFGQNLKRMFQSNSTFETFYKKYLDNRKNTLE<br>TYLSAIENLKTMTDVRPKVLKKKWTELFRFFDKKIYLLSTIETKI<br>NELITKPINLSRGIFEEKPTFINGKNPNKENNQHLFANWFIYAKK<br>QTILQDFYNLPLEQPKAITNLKKHKYKLERSINNLKIEDIYIKQM<br>VDFLYQKLFEQSFIGSLQDLYTSKEKREIEKGKAKNEQTPDESFI<br>WKKQVEINTHNGRIIAKTKIKDIGKFKNLLTDNKIAHLISYDDRI<br>WDFSLNNDGDITKKLYSINTELESYETIRREKLLKQIQQFEQFLL<br>EQETEYSAERKHPEKFEKDCNPNFKKYIIEGVLNKIIPNHEIEEIEI<br>LKSKEDVFKINFSDILILNNDNIKKGYLLIMIRNKFAHNQLIDKN<br>LFNFSLQLYSKNENENFSEYLNKVCQNIIQEFKEKLK |
| *Porphyromonas gulae* | WP_046201018 (SEQ ID NO: 175) | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREKDRARFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFMPEGQHLWPSPEVGTTRTGRS<br>KYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKDMEEKIRKKLQEMIADTDHRLDMLDRQTDRK<br>IRIGRKNAGLPKSGVIADWLVRDMMRFQPVAKDTSGKPLNNSK<br>ANSTEYRMLQRALALFGGEKKRLTPYFRQMNLTGGNNPHPFLH<br>ETRWESHTNILSFYRSYLRARKAFLERIGRSDRMENRPFLLLKEP<br>KTDRQTLVAGWKSEFHLPRGIFTEAVRDCLIEMGYDEVGSYRE<br>VGFMAKAVPLYFERACEDRVQPFYDSPFNVGNSLKPKKGRFLS<br>KEERAEEWERGKERFRDLEAWSHSAARRIEDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEEAPLATVYIEERDTKLLKQGNFKSFVKDRRLNGLFSFVDTG<br>GLAMEQYPISKLRVEYELAKYQTARVCVFELTLRLEESLLTRYP<br>HLPDESFRKMLESWSDPLLAKWPELHGKVRLLIAVRNAFSHNQ<br>YPMYDEAVESSIRKYDPSSPDAIEERMGLNIAHRLSEEVKQAKE<br>TVERIIQV |
| WP_047431796 | *Chryseo-bacterium* sp. YR477 (SEQ ID NO: 176) | METQTIGHGIAYDHSKIQDKHFFGGFLNLAENNIKAVLKAFSEK<br>FNVGNVDVKQFADVSLKDNLPDNDFQKRVSFLKMYFPVVDFIN<br>IPNNRAKFRSDLTTLFKSVDQLRNFYTHYYHKPLDFDASLFILLD<br>DIFARTAKEVRDQKMKDDKTRQLLSKSLSEELQKGYELQLERL<br>KELNRLGKKVNIHDQLGIKNGVLNNAFNHLIYKDGESFKTKLT<br>YSSALTSFESAENGIEISQSGLLFLLSMFLKRKEIEDLKNRNKGF<br>KAKVVIDEDGKVNGLKFMATHWVFSYLCFKGLKSKLSTEFHEE<br>TLLIQIIDELSKVPDELYCAFDKETRDKFIEDINEYVKEGHQDFSL<br>EDAKVIHPVIRKRYENKFNYFAIRFLDEFVKFPSLRFQVHVGNY<br>VHDRRIKNIDGTTFETERVVKDRIKVFGRLSEISSYKAQYLSSVS<br>DKHDETGWEIFPNPSYVFINNNIPIHISVDTSFKKEIADFKKLRRA<br>QVPDELKIRGAEKKRKFEITQMIGSKSVLNQEEPIALLSLNEIPAL<br>LYEILINGKEPAEIERIIKDKLNERQDVIKNYNPENWLPASQISRR<br>LRSNKGERIINTDKLLQLVTKELLVTEQKLKIISDNREALKQKKE<br>GKYIRKFIFTNSELGREAIWLADDIKRFMPADVRKEWKGYQHS<br>QLQQSLAFYNSRPKEALAILESSWNLKDEKIIWNEWILKSFTQN<br>KFFDAFYNEYLKGRKKYFAFLSEHIVQYTSNAKNLQKFIKQQM<br>PKDLFEKRHYIIEDLQTEKNKILSKPFIFPRGIFDKKPTFIKGVKV<br>EDSPESFANWYQYGYQKDHQFQKFYDWKRDYSDVFLEHLGKP<br>FINNGDRRTLGMEELKERIIIKQDLKIKKIKIQDLFLRLIAENLFQ<br>KVFKYSAKLPLSDFYLTQEERMEKENMAALQNVREEGDKSPNI<br>IKDNFIWSKMIPYKKGQIIENAVKLKDIGKLNVLSLDDKVQTLL<br>SYDDAKPWSKIALENEFSIGENSYEVIRREKLFKEIQQFESEILFR<br>SGWDGINHPAQLEDNRNPKFKMYIVNGILRKSAGLYSQGEDIW<br>FEYNADENNLDADVLETKSELVQLAFLVTAIRNKFAHNQLPAK<br>EFYFYIRAKYGFADEPSVALVYLNFTKYAINEFKKVMI |
| *Riemerella anatipestifer* | WP_049354263 (SEQ ID NO: 177) | MFFSFHNAQRVIFKHLYKAFDASLRMVKEDYKAHFTVNLTRDF<br>AHLNRKGKNKQDNPDFNRYRFEKDGFFTESGLLFFTNLFLDKR<br>DAYWMLKKVSGFKASHKQREKMTTEVFCRSRILLPKLRLESRY<br>DHNQMLLDMLSELSRCPKLLYEKLSEENKKHFQVEADGFLDEI<br>EEEQNPFKDTLIRHQDRFPYFALRYLDLNESFKSIRFQVDLGTYH<br>YCIYDKKIGDEQEKRHLTRTLLSFGRLQDFTEINRPQEWKALTK<br>DLDYKETSNQPFISKTTPHYHITDNKIGFRLGTSKELYPSLEIKDG<br>ANRIAKYPYNSGFVAHAFISVHELLPLMFYQHLTGKSEDLLKET<br>VRHIQRIYKDFEEERINTIEDLEKANQGRLPLGAFPKQMLGLLQ<br>NKQPDLSEKAKIKIEKLIAETKLLSHRLNTKLKSSPKLGKRREKL |

TABLE 3-continued

| | | |
|---|---|---|
| | | IKTGVLADWLVKDFMRFQPVAYDAQNQPIKSSKANSTEFWFIR RALALYGGEKNRLEGYFKQTNLIGNTNPHPFLNKFNWKACRNL VDFYQQYLEQREKFLEAIKNQPWEPYQYCLLLKIPKENRKNLV KGWEQGGISLPRGLFTEAIRETLSEDLMLSKPIRKEIKKHGRVGF ISRAITLYFKEKYQDKHQSFYNLSYKLEAKAPLLKREEHYEYW QQNKPQSPTESQRLELHTSDRWKDYLLYKRWQHLEKKLRLYR NQDVMLWLMTLELTKNHFKELNLNYHQLKLENLAVNVQEAD AKLNPLNQTLPMVLPVKVYPATAFGEVQYHKTPIRTVYIREEHT KALKMGNFKALVKDRRLNGLFSFIKEENDTQKHPISQLRLRREL EIYQSLRVDAFKETLSLEEKLLNKHTSLSSLENEFRALLEEWKK EYAASSMVTDEHIAFIASVRNAFCHNQYPFYKEALHAPIPLFTV AQPTTEEKDGLGIAEALLKVLREYCEIVKSQI |
| *Porphyromonas gingivalis* | WP_052912312 (SEQ ID NO: 178) | MTEQNEKPYNGTYYTLEDKHFWAAFFNLARHNAYITLAHIDRQ LAYSKADITNDEDILFFKGQWKNLDNDLERKARLRSLILKHFSF LEGAAYGKKLFESQSSGNKSSKKKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDKYGNNDN PFFKHHFVDREEKVTEAGLLFFVSLFLEKRDAIWMQKKIRGFKG GTEAYQQMTNEVFCRSRISLPKLKLESLRTDDWMLLDMLNELV RCPKLLYDRLREEDRARFRVPVDILSDEDDTDGTEEDPFKNTLV RHQDRFPYFALRYFDLKKVFTSLRFHIDLGTYHFAIYKKNIGEQ PEDRHLTRNLYGFGRIQDFAEEHRPEEWKRLVRDLDYFETGDK PYITQTTPHYHIEKGKIGLRFVPEGQLLWPSPEVGATRTGRSKY AQDKRFTAEAFLSVHELMPMMFYYFLLREKYSEEASAEKVQG RIKRVIEDVYAVYDAFARDEINTRDELDACLADKGIRRGHLPRQ MIAILSQEHKDMEEKVRKKLQEMIADTDHRLDMLDRQTDRKIR IGRKNAGLPKSGVIADWLVRDMMRFQPVAKDTSGKPLNNSKA NSTEYRMLQRALALFGGEKERLTPYFRQMNLTGGNNPHPFLHE TRWESHTNILSFYRSYLKARKAFLQSIGRSDREENHRFLLLKEPK TDRQTLVAGWKSEFHLPRGIFTEAVRDCLIEMGYDEVGSYKEV GFMAKAVPLYFERACKDRVQPFYDYPFNVGNSLKPKKGRFLSK EKRAEEWESGKERFRDLEAWSHSAARRIEDAFVGIEYASWENK KKIEQLLQDLSLWETFESKLKVKADKINIAKLKKEILEAKEHPY HDFKSWQKFERELRLVKNQDIITWMMCRDLMEENKVEGLDTG TLYLKDIRTDVQEQGSLNVLNHVKPMRLPVVVYRADSRGHVH KEEAPLATVYIEERDTKLLKQGNFKSFVKDRRLNGLFSFVDTGA LAMEQYPISKLRVEYELAKYQTARVCAFEQTLELEESLLTRYPH LPDESFREMLESWSDPLLDKWPDLQREVRLLIAVRNAFSHNQY PMYDETIFSSIRKYDPSSLDAIEERMGLNIAHRLSEEVKLAKEMV ERIIQA |
| *Porphyromonas gingivalis* | WP_058019250 (SEQ ID NO: 179) | MTEQNEKPYNGTYYTLKDKHFWAAFFNLARHNAYITLTHIDRQ LAYSKADITNDEDILFFKGQWKNLDNDLERKARLRSLILKHFSF LEGAAYGKKLFESQSSGNKSSKKKELTKKEKEELQANALSLDN LKSILFDFLQKLKDFRNYYSHYRHPESSELPMFDGNMLQRLYN VFDVSVQRVKRDHEHNDKVDPHRHFNHLVRKGKKDRCGNND NPFFKHHFVDREGKVTEAGLLFFVSLFLEKRDAIWMQKKIRGF KGGTETYQQMTNEVFCRSRISLPKLKLESLRTDDWMLLDMLNE LVRCPKSLYDRLREEDRACFRVPVDILSDEDDTDGAEEDPFKNT LVRHQDRFPYFALRYFDLKKVFTSLRFHIDLGTYHFAIYKKNIG EQPEDRHLTRNLYGFGRIQDFAEEHRPEEWKRLVRDLDCFETG DKPYITQTTPHYHIEKGKIGLRFVPEGQHLWPSPEVGATRTGRS KYAQDKRFTAEAFLSVHELMPMMFYYFLLREKYSEEVSAERV QGRIKRVIEDVYAVYDAFARDEINTRDELDACLADKGIRRGHLP RQMIAILSQKHKDMEEKVRKKLQEMIADTDHRLDMLDRQTDR KIRIGRKNAGLPKSGVIADWLVRDMMRFQPVAKDTSGKPLNNS KANSTEYRMLQRALALFGGEKERLTPYFRQMNLTGGNNPHPFL HETRWESHTNILSFYRSYLKARKAFLQSIGRSDRVENHRFLLLK EPKTDRQTLVAGWKGEFHLPRGIFTEAVRDCLIEMGLDEVGSY KEVGFMAKAVPLYFERACKDRVQPFYDYPFNVGNSLKPKKGR FLSKEKRAEEWESGKERFRDLEAWSHSAARRIEDAFAGIENASR ENKKKIEQLLQDLSLWETFESKLKVKADKINIAKLKKEILEAKE HPYLDFKSWQKFERELRLVKNQDIITWMMCRDLMEENKVEGL DTGTLYLKDIRTDVQEQGSLNVLNHVKPMRLPVVVYRADSRG HVHKEQAPLATVYIEERDTKLLKQGNFKSFVKDRRLNGLFSFV DTGALAMEQYPISKLRVEYELAKYQTARVCAFEQTLELEESLLT RYPHLPDENFRKMLESWSDPLLDKWPDLHRKVRLLIAVRNAFS HNQYPMYDEAVFSSIRKYDPSSPDAIEERMGLNIAHRLSEEVKQ AKEMAERIIQA |
| *Flavobacterium columnare* | WP_060381855 (SEQ ID NO: 180) | MSSKNESYNKQKTFNHYKQEDKYFFGGFLNNADDNLRQVGKE FKTRINFNHNNNELASVFKDYFNKEKSVAKREHALNLLSNYFP VLERIQKHTNHNFEQTREIFELLLDTIKKLRDYYTHHYHKPITIN PKVYDFLDDTLLDVLITIKKKKVKNDTSRELLKEKFRPELTQLK NQKREELIKKGKKLLEENLENAVFNHCLRPFLEENKTDDKQNK TVSLRKYRKSKPNEETSITLTQSGLVFLISFFLHRKEFQVFTSGLE GFKAKVNTIKEEEISLNKNNIVYMITHWSYSYYNFKGLKHRIKT DQGVSTLEQNNTTHSLTNTNTKEALLTQIVDYLSKVPNEIYETL SEKQQKEFEEDINEYMRENPENEDSTESSIVSHKVIRKRYENKEN |

TABLE 3-continued

| | | |
|---|---|---|
| | | YFAMRFLDEYAELPTLRFMVNFGDYIKDRQKKILESIQFDSERII KKEIHLFEKLGLVTEYKKNVYLKETSNIDLSRFPLFPSPSYVMA NNNIPFYIDSRSNNLDEYLNQKKKAQSQNRKRNLTFEKYNKEQ SKDAIIAMLQKEIGVKDLQQRSTIGLLSCNELPSMLYEVIVKDIK GAELENKIAQKIREQYQSIRDFTLDSPQKDNIPTTLTKTISTDTSV TFENQPIDIPRLKNALQKELTLTQEKLLNVKQHEIEVDNYNRNK NTYKFKNQPKDKVDDNKLQRKYVFYRNEIGQEANWLASDLIH FMKNKSLWKGYMHNELQSFLAFFEDKKNDCIALLETVFNLKED CILTKDLKNLFLKHGNFIDFYKEYLKLKEDFLNTESTFLENGFIG LPPKILKKELSKRLNYIFIVFQKRQFIIKELEEKKNNLYADAINLS RGIFDEKPTMIPFKKPNPDEFASWFVASYQYNNYQSFYELTPDK IENDKKKKYKNLRAINKVKIQDYYLKLMVDTLYQDLFNQPLDK SLSDFYVSKTDREKIKADAKAYQKRNDSFLWNKVIHLSLQNNR ITANPKLKDIGKYKRALQDEKIATLLTYDDRTWTYALQKPEKE NENDYKELHYTALNMELQEYEKVRSKKLLKQVQELEKQILDKF YDFSNNATHPEDLEIEDKKGKRHPNFKLYITKALLKNESEIINLE NIDIEILIKYYDYNTEKLKEKIKNMDEDEKAKIVNTKENYNKITN VLIKKALVLIIIRNKMAHNQYPPKFIYDLATRFVPKKEEEYFACY FNRVFETITTELWENKKKAKEIV |
| *Porphyromonas gingivalis* | WP_061156470 (SEQ ID NO: 181) | MTEQNERPYNGTYYTLEDKHFWAAFFNLARHNAYITLTHIDRQ LAYSKADITNDEDILFFKGQWKNLDNDLERKARLRSLILKHFSF LEGAAYGKKLFENKSSGNKSSKKKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDRCGNNDN PFFKHHFVDREGKVTEAGLLFFVSLFLEKRDAIWMQKKIRGFK GGTEAYQQMTNEVFCRSRISLPKLKLESLRTDDWMLLDMLNEL VRCPKSLYDRLREEDRARFRVPVDILSDEDDTDGTEEDPFKNTL VRHQDRFPYFALRYFDLKKVFTSLRFHIDLGTYHFAIYKKNIGE QPEDRHLTRNLYGFGRIQDFAEEHRPEEWKRLVRDLDYFETGD KPYITQTTPHYHIEKGKIGLRFVPEGQHLWPSPEVGATRTGRSK YAQDKRLTAEAFLSVHELMPMMFYYFLLREKYSEEVSAEKVQ GRIKRVIEDVYAVYDAFARGEIDTLDRLDACLADKGIRRGHLPR QMIAILSQEHKDMEEKVRKKLQEMIADTDHRLDMLDRQTDRKI RIGRKNAGLPKSGVIADWLVRDMMRFQPVAKDTSGKPLNNSK ANSTEYRMLQRALALFGGEKERLTPYFRQMNLTGGNNPHPFLH ETRWESHTNILSFYRSYLKARKAFLQSIGRSDREENHRFLLLKEP KTDRQTLVAGWKSEFHLPRGIFTEAVRDCLIEMGYDEVGSYKE VGFMAKAVPLYFERACKDRVQPFYDYPFNVGNSLKPKKGRFLS KEKRAEEWESGKERFRLAKLKKEILEAKEHPYLDFKSWQKFER ELRLVKNQDIITWMMCRDLMEENKVEGLDTGTLYLKDIRTEVQ EQGSLNVLNRVKPMRLPVVVYRADSRGHVHKEQAPLATVYIEE RDTKLLKQGNFKSFVKDRRLNGLFSFVDTGGLAMEQYPISKLR VEYELAKYQTARVCAFEQTLELEESLLTRCPHLPDKNFRKMLES WSDPLLDKWPDLQREVWLLIAVRNAFSHNQYPMYDEAVFSSIR KYDPSPSPDAIEERMGLNIAHRLSEEVKQAKEMAERIIQA |
| *Porphyromonas gingivalis* | WP_061156637 (SEQ ID NO: 182) | MNTVPASENKGQSRTVEDDPQYFGLYLNLARENLIEVESHVRIK FGKKKLNEESLKQSLLCDHLLSVDRWTKVYGHSRRYLPFLHYF DPDSQIEKDHDSKTGVDPDSAQRLIRELYSLLDFLRNDFSHNRL DGTTFEHLEVSPDISSFITGTYSLACGRAQSRFADFFKPDDFVLA KNRKEQLISVADGKECLTVSGLAFFICLFLDREQASGMLSRIRGF KRTDENWARAVHETFCDLCIRHPHDRLESSNTKEALLLDMLNE LNRCPRILYDMLPEEERAQFLPALDENSMNNLSENSLNEESRLL WDGSSDWAEALTKRIRHQDRFPYLMLRFIEEMDLLKGIRFRVD LGEIELDSYSKKVGRNGEYDRTITDHALAFGKLSDFQNEEEVSR MISGEASYPVRFSLFAPRYAIYDNKIGYCHTSDPVYPKSKTGEK RALSNPQSMGFISVHDLRKLLLMELLCEGSFSRMQSGFLRKANR ILDETAEGKLQFSALFPEMRHRFIPPQNPKSKDRREKAETTLEKY KQEIKGRKDKLNSQLLSAFDMNQRQLPSRLLDEWMNIRPASHS VKLRTYVKQLNEDCRLRLRKFRKDGDGKARAIPLVGEMATFLS QDIVRMIISEETKKLITSAYYNEMQRSLAQYAGEENRRQFRAIV AELHLLDPSSGHPFLSATMETAHRYTEDFYKCYLEKKREWLAK TFYRPEQDENTKRRISVFFVPDGEARKLLPLLIRRRMKEQNDLQ DWIRNKQAHPIDLPSHLFDSKIMELLKVKDGKKKWNEAFKDW WSTKYPDGMQPFYGLRRELNIHGKSVSYIPSDGKKFADCYTHL MEKTVQDKKRELRTAGKPVPPDLAADIKRSFHRAVNEREFMLR LVQEDDRLMLMAINKMMTDREEDILPGLKNIDSILDKENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEMPLIYRDVSAKVGSIEGSSAKDLPE GSSLVDSLWKKYEMIIRKILPILDPENRFFGKLLNNMSQPINDL |
| *Riemerella anatipestifer* | WP_061710138 (SEQ ID NO: 183) | MFFSFHNAQRVIFKHLYKAFDASLRMVKEDYKAHFTVNLTRDF AHLNRKGKNKQDNPDFNRYRFEKDGFFTESGLLFFTNLFLDKR DAYWMLKKVSGFKASHKQSEKMTTEVFCRSRILLPKLRLESRY DHNQMLLDMLSELSRCPKLLYEKLSEKDKKCFQVEADGFLDEI EEEQNPFKDTLIRHQDRFPYFALRYLDLNESFKSIRFQVDLGTYH YCIYDKKIGYEQEKRHLTRTLLNFGRLQDFTEINRPQEWKALTK |

TABLE 3-continued

| | | |
|---|---|---|
| | | DLDYNETSNQPFISKTTPHYHITDNKIGFRLRTSKELYPSLEVKD<br>GANRIAKYPYNSDFVAHAFISISVHELLPLMFYQHLTGKSEDLL<br>KETVRHIQRIYKDFEEERINTIEDLEKANQGRLPLGAFPKQMLGL<br>LQNKQPDLSEKAKIKIEKLIAETKLLSHRLNTKLKSSPKLGKRRE<br>KLIKTGVLADWLVKDFMRFQPVVYDAQNQPIKSSKANSTESRLI<br>RRALALYGGEKNRLEGYFKQTNLIGNTNPHPFLNKFNWKACRN<br>LVDFYQQYLEQREKFLEAIKHQPWEPYQYCLLLKVPKENRKNL<br>VKGWEQGGISLPRGLFTEAIRETLSKDLTLSKPIRKEIKKHGRVG<br>FISRAITLYFKEKYQDKHQSFYNLSYKLEAKAPLLKKEEHYEYW<br>QQNKPQSPTESQRLELHTSDRWKDYLLYKRWQHLEKKLRLYR<br>NQDIMLWLMTLELTKNHFKELNLNYHQLKLENLAVNVQEADA<br>KLNPLNQTLPMVLPVKVYPTTAFGEVQYHETPIRTVYIREEQTK<br>ALKMGNFKALVKDRHLNGLFSFIKEENDTQKHPISQLRLRRELE<br>IYQSLRVDAFKETLSLEEKLLNKHASLSSLENEFRTLLEEWKKK<br>YAASSMVTDKHIAFIASVRNAFCHNQYPFYKETLHAPILLFTVA<br>QPTTEEKDGLGIAEALLRVLREYCEIVKSQI |
| *Flavobacterium columnare* | WP_063744070 (SEQ ID NO: 184) | MSSKNESYNKQKTFNHYKQEDKYFFGGFLNNADDNLRQVGKE<br>FKTRINFNHNNNELASVFKDYFNKEKSVAKREHALNLLSNYFP<br>VLERIQKHINHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLRPFLEENKTDDKQNKT<br>VSLRKYRKSKPNEETSITLTQSGLVFLMSFFLHRKEFQVFTSGLE<br>GFKAKVNTIKEEKISLNKNNIVYMITHWSYSYYNFKGLKHRIKT<br>DQGVSTLEQNNTTHSLTNTNTKEALLTQIVDYLSKVPNEIYETL<br>SEKQQKEFEEDINEYMRENPENEDSTESSIVSHKVIRKRYENKFN<br>YFAMRFLDEYAELPTLRFMVNFGDYIKDRQKKILESIQFDSERII<br>KKEIHLFEKLGLVTEYKKNVYLKETSNIDLSRFPLFPSPSYVMA<br>NNNIPFYIDSRSNNLDEYLNQKKKAQSQNRKRNLTFEKYNKEQ<br>SKDAIIAMLQKEIGVKDLQQRSTIGLLSCNELPSMLYEVIVKDIK<br>GAELENKIAQKIREQYQSIRDFTLNSPQKDNIPTTLIKTISTDTSV<br>TFENQPIDIPRLKNAIQKELALTQEKLLNVKQHEIEVNNYNRNK<br>NTYKFKNQPKDKVDDNKLQRKYVFYRNEIGQEANWLASDLIH<br>FMKNKSLWKGYMHNELQSFLAFFEDKKNDCIALLETVFNLKED<br>CILTKDLKNLFLKHGNFIDFYKEYLKLKEDFLNTESTFLENGFIG<br>LPPKILKKELSKRLNYIFIVFQKRQFIIKELEEKKNNLYADAINLS<br>RGIFDEKPTMIPFKKPNPDEFASWFVASYQYNNYQSFYELTPDK<br>IENDKKKKYKNLRAINKVKIQDYYLKLMVDTLYQDLFNQPLDK<br>SLSDFYVSKTDREKIKADAKAYQKRNDSFLWNKVIHLSLQNNR<br>ITANPKLKDIGKYKRALQDEKIATLLTYDDRTWTYALQKPEKE<br>NENDYKELHYTALNMELQEYEKVRSKKLLKQVQELEKQILDKF<br>YDFSNNATHPEDLEIEDKKGKRHPNFKLYITKALLKNESEIINLE<br>NIDIEILIKYYDYNTEKLKEKIKNMDEDEKAKIVNTKENYNKITN<br>VLIKKALVLIIIRNKMAHNQYPPKFIYDLATRFVPKKEEEYFACY<br>FNRVFETITTELWENKKKAKEIV |
| *Riemerella anatipestifer* | WP_064970887 (SEQ ID NO: 185) | MEKPLPPNVYTLKHKFFWGAFLNIARHNAFITICHINEQLGLTTP<br>PNDDKIADVVCGTWNNILNNDHDLLKKSQLTELILKHFPFLAA<br>MCYHPPKKEGKKKGSQKEQQKEKENEAQSQAEALNPSELIKVL<br>KTLVKQLRTLRNYYSHHSHKKPDAEKDIFKHLYKAFDASLRMV<br>KEDYKAHFTVNLTQDFAHLNRKGKNKQDNPDFDRYRFEKDGF<br>FTESGLLFFTNLFLDKRDAYWMLKKVSGFKASHKQSEKMTTEV<br>FCRSRILLPKLRLESRYDHNQMLLDMLSELSRYPKLLYEKLSEE<br>DKKRFQVEADGFLDEIEEEQNPFKDTLIRHQDRFPYFALRYLDL<br>NESFKSIRFQVDLGTYHYCIYDKKIGDEQEKRHLTRTLLSFGRL<br>QDFTEINRPQEWKALTKDLDYKETSKQPFISKTTPHYHITDNKIG<br>FRLGTSKELYPSLEVKDGANRIAQYPYNSDFVAHAFISVHELLP<br>LMFYQHLTGKSEDLLKETVRHIQRIYKDFEEERINTIEDLEKANQ<br>GRLPLGAFPKQMLGLLQNKQPDLSEKAKIKIEKLIAETKLLSHR<br>LNTKLKSSPKLGKRREKLIKTGVLADWLVKDFMRFQPVAYDA<br>QNQPIESSKANSTEFQLIQRALALYGGEKNRLEGYFKQTNLIGN<br>TNPHPFLNKFNWKACRNLVDFYQQYLEQREKFLEAIKNQPWEP<br>YQYCLLLKIPKENRKNLVKGWEQGGISLPRGLFTEAIRETLSKD<br>LTLSKPIRKEIKKHGRVGFISRAITLYFREKYQDDHQSFYDLPYK<br>LEAKASPLPKKEHYEYWQQNKPQSPTELQRLELHTSDRWKDYL<br>LYKRWQHLEKKLRLYRNQDVMLWLMTLELTKNHFKELNLNY<br>HQLKLENLAVNVQEADAKLNPLNQTLPMVLPVKVYPATAFGE<br>VQYQETPIRTVYIREEQTKALKMGNFKALVKDRRLNGLFSFIKE<br>ENDTQKHPISQLRLRRELEIYQSLRVDAFKETLNLEEKLLKKHTS<br>LSSVENKFRILLEEWKKEYAASSMVTDEHIAFIASVRNAFCHNQ<br>YPFYEEALHAPIPLFTVAQQTTEEKDGLGIAEALLRVLREYCEIV<br>KSQI |
| *Sinomicrobium oceani* | WP_072319476.1 (SEQ ID NO: 186) | MESTTTLGLHLKYQHDLFEDKHYFGGGVNLAVQNIESIFQAFA<br>ERYGIQNPLRKNGVPAINNIFHDNISISNYKEYLKFLKQYLPVVG<br>FLEKSNEINIFEFREDFEILINAIYKLRHFYTHYYHSPIKLEDRFYT<br>CLNELFVAVAIQVKKHKMKSDKTRQLLNKNLHQLLQQLIEQKR<br>EKLKDKKAEGEKVSLDTKSIENAVLNDAFVHLLDKDENIRLNY<br>SSRLSEDIITKNGITLSISGLLFLLSLFLQRKEAEDLRSRIEGFKGK<br>GNELRFMATHWVFSYLNVKRIKHRLNTDFQKETLLIQIADELSK |

TABLE 3-continued

| | | |
|---|---|---|
| | | VPDEVYKTLDHENRSKFLEDINEYIREGNEDASLNESTVVHGVI<br>RKRYENKFHYLVLRYLDEFVDFPSLRFQVHLGNYIHDRRDKVI<br>DGTNFITNRVIKEPIKVFGKLSHVSKLKSDYMESLSREHKNGWD<br>VFPNPSYNFVGHNIPIFINLRSASSKGKELYRDLMKIKSEKKKKS<br>REEGIPMERRDGKPTKIEISNQIDRNIKDNNFKDIYPGEPLAMLS<br>LNELPALLFELLRRPSITPQDIEDRMVEKLYERFQIIRDYKPGDG<br>LSTSKISKKLRKADNSTRLDGKKLLRAIQTETRNAREKLHTLEE<br>NKALQKNRKRRTVYTTREQGREASWLAQDLKREMPIASRKEW<br>RGYHHSQLQQILAFYDQNPKQPLELLEQFWDLKEDTYVWNSWI<br>HKSLSQHNGFVPMYEGYLKGRLGYYKKLESDIIGFLEEHKVLK<br>RYYTQQHLNVIFRERLYFIKTETKQKLELLARPLVFPRGIFDDKP<br>TFVQDKKVVDHPELFADWYVYSYKDDHSFQEFYHYKRDYNEI<br>FETELSWDIDFKDNKRQLNPSEQMDLFRMKWDLKIKKIKIQDIF<br>LKIVAEDIYLKIFGHKIPLSLSDFYISRQERLTLDEQAVAQSMRLP<br>GDTSENQIKESNLWQTTVPYEKEQIREPKIKLKDIGKFKYFLQQ<br>QKVLNLLKYDPQHVWTKAELEEELYIGKHSYEVVRREMLLQK<br>CHQLEKHILEQFRFDGSNHPRELEQGNHPNFKMYIVNGILTKRG<br>ELEIEAENWWLELGNSKNSLDKVEVELLTMKTIPEQKAFLLILIR<br>NKFAHNQLPADNYFHYASNLMNLKKSDTYSLFWFTVADTIVQ<br>EFMSL |
| *Reichenbachiella agariperforans* | WP_073124441.1 (SEQ ID NO: 187) | MKTNPLIASSGEKPNYKKFNTESDKSFKKIFQNKGSIAPIAEKAC<br>KNFEIKSKSPVNRDGRLHYFSVGHAFKNIDSKNVFRYELDESQM<br>DMKPTQFLALQKEFFDFQGALNGLLKHIRNVNSHYVHTFEKLEI<br>QSINQKLITFLIEAFELAVIHSYLNEEELSYEAYKDDPQSGQKLV<br>QFLCDKFYPNKEHEVEERKTILAKNKRQALEHLLFIEVTSDIDW<br>KLFEKHKVFTISNGKYLSFHACLFLLSLFLYKSEANQLISKIKGF<br>KRNDDNQYRSKRQIFTFFSKKFTSQDVNSEEQHLVKFRDVIQYL<br>NHYPSAWNKHLELKSGYPQMTDKLMRYIVEAEIYRSFPDQTDN<br>HRFLLFAIREFFGQSCLDTWTGNTPINFSNQEQKGFSYEINTSAEI<br>KDIETKLKALVLKGPLNFKEKKEQNRLEKDLRREKKEQPTNRV<br>KEKLLTRIQHNMLYVSYGRNQDRFMDFAARFLAETDYFGKDA<br>KFKMYQFYTSDEQRDHLKEQKKELPKKEFEKLKYHQSKLVDY<br>FTYAEQQARYPDWDTPFVVENNAIQIKVTLFNGAKKIVSVQRN<br>LMLYLLEDALYSEKRENAGKGLISGYFVHHQKELKDQLDILEK<br>ETEISREQKREFKKLLPKRLLHRYSPAQINDTTEWNPMEVILEEA<br>KAQEQRYQLLLEKAILHQTEEDFLKRNKGKQFKLRFVRKAWH<br>LMYLKELYMNKVAEHGHHKSFHITKEEFNDFCRWMFAFDEVP<br>KYKEYLCDYFSQKGFFNNAEFKDLIESSTSLNDLYEKTKQRFEG<br>WSKDLTKQSDENKYLLANYESMLKDDMLYVNISHFISYLESKG<br>KINRNAHGHIAYKALNNVPHLIEEYYYKDRLAPEEYKSHGKLY<br>NKLKTVKLEDALLYEMAMHYLSLEPALVPKVKTKVKDILSSNI<br>AFDIKDAAGHHLYHLLIPFHKIDSFVALINHQSQQEKDPDKTSFL<br>AKIQPYLEKVKNSKDLKAVYHYYKDTPHTLRYEDLNMIHSHIV<br>SQSVQFTKVALKLEEYFIAKKSITLQIARQISYSEIADLSNYFTDE<br>VRNTAFHFDVPETAYSMILQGIESEFLDREIKPQKPKSLSELSTQ<br>QVSVCTAFLETLHNNLFDRKDDKKERLSKARERYFEQIN |

In certain example embodiments, the RNA-targeting effector protein is a Cas13c effect protein as disclosed in PCT Application No. US18/39595 filed Jun. 26, 2018, and PCT Application No. US 2017/047193 filed Aug. 16, 2017. In certain example embodiments, the CRISPR effector protein is a Cas13c protein from Table 4A or 4B.

TABLE 4A

| | |
|---|---|
| Fusobacterium necrophorum subsp. funduliforme ATCC 51357 contig00003 (SEQ ID NO: 188) | MEKFRRQNRNSIIKIIISNYDTKGIKELKVRYRKQAQLDTFIIKTE<br>IVNNDIFIKSIIEKAREKYRYSFLFDGEEKYHFKNKSSVEIVKKDI<br>FSQTPDNMIRNYKITLKISEKNPRVVEAEIEDLMNSTILKDGRRS<br>ARREKSMTERKLIEEKVAKNYSLLANCPMEEVDSIKIYKIKRFL<br>TYRSNMLLYFASINSFLCEGIKGKDNETEEIWHLKDNDVRKEK<br>VRENFKNKLIQSTENYNSSLKNQIEEKEKLLRKEFKKGAFYRTII<br>KKLQQERIKELSEKSLTEDCEKIIKLYSKLRHSLMHYDYQYFEN<br>LFENKKNDDLMKDLNLDLFKSLPLIRKMKLNNKVNYLEDGDT<br>LFVLQKTKKAKTLYQIYDALCEQKNGFNKFINDFFVSDGEENT<br>VFKQIINEKFQSEMEFLEKRISESEKKNEKLKKKLDSMKAHFRN<br>INSEDTKEAYFWDIHSSRNYKTKYNERKNLVNEYTELLGSSKE<br>KKLLREEITKINRQLLKLKQEMEEITKKNSLFRLEYKMKIAFGF<br>LFCEFDGNISKFKDEFDASNQEKIIQYHKNGEKYLTSFLKEEEK<br>EKFNLEKMQKIIQKTEEEDWLLPETKNNLFKFYLLTYLLLPYEL<br>KGDFLGFVKKHYYDIKNVDFIDENQNNIQVSQTVEKQEDYFYH<br>KIRLFEKNTKKYEIVKYSIVPNEKLKQYFEDLGIDIKYLTVEQKS<br>EVSEEKNKKVSLKNNGMFNKTILLFVFKYYQIAFKLFNDIELYS<br>LFFLREKSGKPLEIFRKELESKMKDGYLNFGQLLYVVYEVLVK<br>NKDLDKILSKKIDYRKDKSFSPEIAYLRNFLSHLNYSKFLDNFM<br>KINTNKSDENKEVLIPSIKIQKMIQFIEKCNLQNQIDFDFNFVND<br>FYMRKEKMFFIQLKQIFPDINSTEKQKMNEKEEILRNRYHLTDK<br>KNEQIKDEHEAQSQLYEKILSLQKIYSSDKNNFYGRLKEEKLLF<br>LEKQGKKKLSMEEIKDKIAGDISDLLGILKKEITRDIKDKLTEKF |

TABLE 4A-continued

| | |
|---|---|
| | RYCEEKLLNLSFYNHQDKKKEESIRVFLIRDKNSDNFKFESILD |
| | DGSNKIFISKNGKEITIQCCDKVLETLIIEKNTLKISSNGKIISLIPH |
| | YSYSIDVKY |
| Fusobacterium | MEKFRRQNRSSIIKIIISNYDTKGIKELKVRYRKQAQLDTFIIKTE |
| necrophorum | IVNNDIFIKSIIEKAREKYRYSFLFDGEEKYHFKNKSSVEIVKKDI |
| DJ-2 | FSQTPDNMIRNYKITLKISEKNPRVVEAEIEDLMNSTILKDGRRS |
| contig0065, | ARREKSMTERKLIEEKVAENYSLLANCPMEEVDSIKIYKIKRFL |
| whole genome | TYRSNMLLYFASINSFLCEGIKGKDNETEEIWHLKDNDVRKEK |
| shotgun | VKENFKNKLIQSTENYNSSLKNQIEEKEKLLRKESKKGAFYRTII |
| sequence | KKLQQERIKELSEKSLTEDCEKIIKLYSELRHPLMHYDYQYFEN |
| (SEQ ID NO: | LFENKENSELTKNLNLDIFKSLPLVRKMKLNNKVNYLEDNDTL |
| 189) | FVLQKTKKAKTLYQIYDALCEQKNGFNKFINDFFVSDGEENTV |
| | FKQIINEKFQSEIEFLEKRISESEKKNEKLKKKLDSMKAHFRNIN |
| | SEDTKEAYFWDIHSSRNYKTKYNERKNLVNEYTELLGSSKEKK |
| | LLREEITKINRQLLKLKQEMEEITKKNSLFRLEYKMKMAFGFLF |
| | CEFDGNISRFKDEFDASNQEKIIQYHKNGEKYLTYFLKEEEKEK |
| | FNLKKLQETIQKTGEENWLLPQNKNNLFKFYLLTYLLLPYELK |
| | GDFLGFVKKHYYDIKNVDFMDENQSSKIIESKEDDFYHKIRLFE |
| | KNTKKYEIVKYSIVPDKKLKQYFKDLGIDTKYLILDQKSEVSGE |
| | KNKKVSLKNNGMFNKTILLFVFKYYQIAFKLFNDIELYSLFFLR |
| | EKSGKPFEVFLKELKDKMIGKQLNFGQLLYVVYEVLVKNKDL |
| | SEILSERIDYRKDMCFSAEIADLRNFLSHLNYSKFLDNFMKINT |
| | NKSDENKEVLIPSIKIQKMIKFIEECNLQSQIDFDFNFVNDFYMR |
| | KEKMFFIQLKQIFPDINSTEKQKMNEKEEILRNRYHLTDKKNEQ |
| | IKDEHEAQSQLYEKILSLQKIYSSDKNNFYGRLKEEKLLFLEKQ |
| | EKKKLSMEEIKDKIAGDISDLLGILKKEITRDIKDKLTEKFRYCE |
| | EKLLNLSFYNHQDKKKEESIRVFLIRDKNSDNFKFESILDDGSN |
| | KIFISKNGKEITIQCCDKVLETLIIEKNTLKISSNGKIISLIPHYSYS |
| | IDVKY |
| Fusobacterium | MKVRYRKQAQLDTFIIKTEIVNNDIFIKSIIEKAREKYRYSFLFD |
| necrophorum | GEEKYHFKNKSSVEIVKNDIFSQTPDNMIRNYKITLKISEKNPRV |
| BFTR-1 | VEAEIEDLMNSTILKDGRRSARREKSMTERKLIEEKVAENYSLL |
| contig0068 | ANCPIEEVDSIKIYKIKRFLTYRSNMLLYFASINSFLCEGIKGKD |
| (SEQ ID NO: | NETEEIWHLKDNDVRKEKVKENFKNKLIQSTENYNSSLKNQIE |
| 190) | EKEKLSSKEFKKGAFYRTIIKKLQQERIKELSEKSLTEDCEKIIKL |
| | YSELRHPLMHYDYQYFENLFENKENSELTKNLNLDIFKSLPLV |
| | RKMKLNNKVNYLEDNDTLFVLQKTKKAKTLYQIYDALCEQK |
| | NGFNKFINDFFVSDGEENTVFKQIINEKFQSEMEFLEKRISESEK |
| | KNEKLKKKLDSMKAHFRNINSEDTKEAYFWDIHSSRNYKTKY |
| | NERKNLVNEYTKLLGSSKEKKLLREEITKINRQLLKLKQEMEEI |
| | TKKNSLFRLEYKMKIAFGFLFCEFDGNISKFKDEFDASNQEKIIQ |
| | YHKNGEKYLTSFLKEEEKEKFNLEKMQKIIQKTEEEDWLLPET |
| | KNNLFKFYLLTYLLLPYELKGDFLGFVKKHYYDIKNVDFMDE |
| | NQNNIQVSQTVEKQEDYFYHKIRLFEKNTKKYEIVKYSIVPNEK |
| | LKQYFEDLGIDIKYLTGSVESGEKWLGENLGIDIKYLTVEQKSE |
| | VSEEKNKKVSLKNNGMFNKTILLFVFKYYQIAFKLFNDIELYSL |
| | FFLREKSEKPFEVFLEELKDKMIGKQLNFGQLLYVVYEVLVKN |
| | KDLDKILSKKIDYRKDKSFSPEIAYLRNFLSHLNYSKFLDNFMK |
| | INTNKSDENKEVLIPSIKIQKMIQFIEKCNLQNQIDFDFNFVNDF |
| | YMRKEKMFFIQLKQIFPDINSTEKQKKSEKEEILRKRYHLINKK |
| | NEQIKDEHEAQSQLYEKILSLQKIFSCDKNNFYRRLKEEKLLFL |
| | EKQGKKKISMKEIKDKIASDISDLLGILKKEITRDIKDKLTEKFR |
| | YCEEKLLNISFYNHQDKKKEEGIRVFLIRDKNSDNFKFESILDD |
| | GSNKIFISKNGKEITIQCCDKVLETLMIEKNTLKISSNGKIISLIPH |
| | YSYSIDVKY |
| Fusobacterium | MTEKKSIIFKNKSSVEIVKKDIFSQTPDNMIRNYKITLKISEKNPR |
| necrophorum | VVEAEIEDLMNSTILKDGRRSARREKSMTERKLIEEKVAENYSL |
| subsp. | LANCPMEEVDSIKIYKIKRFLTYRSNMLLYFASINSFLCEGIKGK |
| funduliforme | DNETEEIWHLKDNDVRKEKVKENFKNKLIQSTENYNSSLKNQI |
| 1_1_36S | EEKEKLLRKESKKGAFYRTIIKKLQQERIKELSEKSLTEDCEKII |
| cont1.14 | KLYSELRHPLMHYDYQYFENLFENKENSELTKNLNLDIFKSLPL |
| (SEQ ID NO: | VRKMKLNNKVNYLEDNDTLFVLQKTKKAKTLYQIYDALCEQ |
| 191) | KNGFNKFINDFFVSDGEENTVFKQIINEKFQSEMEFLEKRISESE |
| | KKNEKLKKKFDSMKAHFHNINSEDTKEAYFWDIHSSSNYKTK |
| | YNERKNLVNEYTELLGSSKEKKLLREEITQINRKLLKLKQEME |
| | EITKKNSLFRLEYKMKIAFGFLFCEFDGNISKFKDEFDASNQEKI |
| | IQYHKNGEKYLTYFLKEEEKEKFNLEKMQKIIQKTEEEDWLLP |
| | ETKNNLFKFYLLTYLLLPYELKGDFLGFVKKHYYDIKNVDFMD |
| | ENQNNIQVSQTVEKQEDYFYHKIRLFEKNTKKYEIVKYSIVPNE |
| | KLKQYFEDLGIDIKYLTGSVESGEKWLGENLGIDIKYLTVEQKS |
| | EVSEEKIKKFL |
| Fusobacterium | MGKPNRSSIIKIIISNYDNKGIKEVKVRYNKQAQLDTFLIKSELK |
| perfoetens | DGKFILYSIVDKAREKYRYSFEIDKTNINKNEILIIKKDIYSNKED |
| ATCC 29250 | KVIRKYILSFEVSEKNDRTIVTKIKDCLETQKKEKFERENTRRLI |

TABLE 4A-continued

| | |
|---|---|
| T364DRAFT_ scaffold00009.9_ C (SEQ ID NO: 192) | SETERKLLSEETQKTYSKIACCSPEDIDSVKIYKIKRYLAYRSNM LLFFSLINDIFVKGVVKDNGEEVGEIWRIIDSKEIDEKKTYDLLV ENFKKRMSQEFINYKQSIENKIEKNTNKIKEIEQKLKKEKYKKEI NRLKKQLIELNRENDLLEKDKIELSDEEIREDIEKILKIYSDLRH KLMHYNYQYFENLFENKKISKEKNEDVNLTELLDLNLFRYLPL VRQLKLENKTNYLEKEDKITVLGVSDSAIKYYSYYNFLCEQKN GFNNFINSFFSNDGEENKSFKEKINLSLEKEIEIMEKETNEKIKEI NKNELQLMKEQKELGTAYVLDIHSLNDYKISHNERNKNVKLQ NDIMNGNRDKNALDKINKKLVELKIKMDKITKRNSILRLKYKL QVAYGFLMEEYKGNIKKFKDEFDISKEKIKSYKSKGEKYLEVK SEKKYITKILNSIEDIHNITWLKNQEENNLFKFYVLTYILLPFEFR GDFLGFVKKHYYDIKNVEFLDENNDRLTPEQLEKMKNDSFFN KIRLFEKNSKKYDILKESILTSERIGKYFSLLNTGAKYFEYGGEE NRGIFNKNIIIPIFKYYQIVLKLYNDVELAMLLTLSESDEKDINKI KELVTLKEKVSPKKIDYEKKYKFSVLLDCFNRIINLGKKDFLAS EEVKEVAKTFTNLAYLRNKICHLNYSKFIDDLLTIDTNKSTTDS EGKLLINDRIRKLIKFIRENNQKMNISIDYNYINDYYMKKEKFIF GQRKQAKTIIDSGKKANKRNKAEELLKMYRVKKENINLIYELS KKLNELTKSELFLLDKKLLKDIDFTDVKIKNKSFFELKNDVKEV ANIKQALQKHSSELIGIYKKEVIMAIKRSIVSKLIYDEEKVLSIIIY DKTNKKYEDFLLEIRRERDINKFQFLIDEKKEKLGYEKIIETKEK KKVVVKIQNNSELVSEPRIIKNKDKKKAKTPEEISKLGILDLTN HYCFNLKITL |
| Fusobacterium ulcerans ATCC 49185 cont2.38 (SEQ ID NO: 193) | MENKGNNKKIDFDENYNILVAQIKEYFTKEIENYNNRIDNIIDK KELLKYSEKKEESEKNKKLEELNKLKSQKLKILTDEEIKADVIK IIKIFSDLRHSLMHYEYKYFENLFENKKNEELAELLNLNLFKNL TLLRQMKIENKTNYLEGREEFNIIGKNIKAKEVLGHYNLLAEQ KNGFNNFINSFFVQDGTENLEFKKLIDEHFVNAKKRLERNIKKS KKLEKELEKMEQHYQRLNCAYVWDIHTSTTYKKLYNKRKSLI EEYNKQINEIKDKEVITAINVELLRIKKEMEEITKSNSLFRLKYK MQIAYAFLEIEFGGNIAKFKDEFDCSKMEEVQKYLKKGVKYLK YYKDKEAQKNYEFPFEEIFENKDTHNEEWLENTSENNLFKFYIL TYLLLPMEFKGDFLGVVKKHYYDIKNVDFTDESEKELSQVQLD KMIGDSFFHKIRLFEKNTKRYEIIKYSILTSDEIKRYFRLLELDVP YFEYEKGTDEIGIFNKNIILTIFKYYQIIFRLYNDLEIHGLFNISSD LDKILRDLKSYGNKNINFREFLYVIKQNNNSSTEEEYRKIWENL EAKYLRLHLLTPEKEEIKTKTKEELEKLNEISNLRNGICHLNYK EIIEEILKTEISEKNKEATLNEKIRKVINFIKENELDKVELGENFIN DFFMKKEQFMFGQIKQVKEGNSDSITTERERKEKNNKKLKETY ELNCDNLSEFYETSNNLRERANSSSLLEDSAFLKKIGLYKVKNN KVNSKVKDEEKRIENIKRKLLKDSSDIMGMYKAEVVKKLKEK LILIFKHDEEKRIYVTVYDTSKAVPENISKEILVKRNNSKEEYFF EDNNKKYVTEYYTLEITETNELKVIPAKKLEGKEFKTEKNKEN KLMLNNHYCFNVKIIY |
| Anaerosalibacter sp. ND1 genome assembly Anaerosali-bacter massiliensis ND1 (SEQ ID NO: 194) | MKSGRREKAKSNKSSIVRVIISNFDDKQVKEIKVLYTKQGGIDV IKFKSTEKDEKGRMKFNFDCAYNRLEEEEFNSFGGKGKGKQSFFV TTNEDLTELHVTKRHKTTGEIIKDYTIQGKYTPIKQDRTKVTVSI TDNKDHFDSNDLGDKIRLSRSLTQYTNRILLDADVMKNYREIV CSDSEKVDETINIDSQEIYKINRFLSYRSNMIIYYQMINNFLLHY DGEEDKGGNDSINLINEIWKYENKKNDEKEKIIERSYKSIEKSIN QYILNHNTEVESGDKEKKIDISEERIKEDLKKTFILFSRLRHYMV HYNYKFYENLYSGKNFIIYNKDKSKSRRFSELLDLNIFKELSKIK LVKNRAVSNYLDKKTTIHVLNKNINAIKLLDIYRDICETKNGFN NFINNMMTISGEEDKEYKEMVTKHFNENMNKLSIYLENFKKHS DFKTNNKKKETYNLLKQELDEQKKLRLWFNAPYVYDIHSSKK YKELYVERKKYVDIHSKLIEAGINNDNKKKLNEINVKLCELNT EMKEMTKLNSKYRLQYKLQLAFGFILEEFNLDIDKFVSAFDKD NNLTISKFMEKRETYLSKSLDRRDNRFKKLIKDYKFRDTEDIFC SDRENNLVKLYILMYILLPVEIRGDFLGFVKKNYYDLKHVDFID KRNNDNKDTFFHDLRLFEKNVKRLEVTSYSLSDGFLGKKSREK FGKELEKFIYKNVSIALPTNIDIKEFNKSLVLPMMKNYQIIFKLL NDIEISALFLIAKKEGNEGSITFKKVIDKVRKEDMNGNINFSQV MKMALNEKVNCQIRNSIAHINMKQLYIEPLNIYINNNQNKKTIS EQMEEIIDICITKGLTGKELNKNIINDYYMKKEKLVFNLKLRKR NNLVSIDAQQKNMKEKSILNKYDLNYKDENLNIKEIILKVNDL NNKQKLLKETTEGESNYKNALSKDILLLNGIIRKNINFKIKEMIL GIIQQNEYRYVNINIYDKIRKEDHNIDLKINNKYIEIS CYENKSN ESTDERINFKIKYMDLKVKNELLVPSCYEDIYIKKKIDLEIRYIE NCKVVYIDIYYKKYNINLEFDGKTLFVKFNKDVKKNNQKVNL ESNYIQNIKFIVS |

TABLE 4B

| Name | sequence |
|---|---|
| EH019 081 (SEQ ID NO: 315) | mtekksiifknkssveivkkdifsqtpdnmirnykitlkiseknprvveaeiedlmnstilkdgrrsarreksmte<br>rklieekvaenysllancpmeevdsikiykikrfltyrsnmllyfasinsflcegikgkdneteeiwhlkdndvrke<br>kvkenfknkliqstenynsslknqieekekllrkeskkgafyrtiikklqqerikelsekssltedcekiiklyselrhpl<br>mhydyqyfenlfenkenseltknlnldifksl plvrkmklnnkvnylednd tlfvlqktkkaktlyqiydalceqk<br>ngfnkfindffvsdgeentvfkqiinekfqsemeflekrisesekkneklkkkfdsmkahfhninsedtkeayf<br>wdihsssnyktkynerknlvneytellgsskekkllreeitqinrkllklkqemeeitkknslfrleykmkiafgflf<br>cefdgniskfkdefdasnqekiiqyhkngekyltyflkeeekekfnlekmqkiiqkteeedwllpetknnlfkfy<br>lltylllpyelkgdflgfvkkhyydiknvdfmdenqnniqvsqtvekqedyfyhkirlfekntkkyeivkysivpn<br>eklkqyfedlgidikyltgsvesgekwlgenlgidikyltveqksevseekikkfl |
| WP_0 94899 336 (SEQ ID NO: 316) | mekdkkgekidisqemieedlrkililfsrlrhsmvhydyefyqalysgkdfvisdknnlenrmisqlldlnifkel<br>skvklikdkaisnyldknttihvlgqdikairlldiyrdicgskngfnkfintmitisgeedreykekviehfnkkme<br>nlstyleklekqdnakrnnkrvynllkqklieqqklkewfggpyvydihsskrykelyierkklvdrhsklfeegld<br>eknkkeltkindelsklnsemkemtklnskyrlqyklqlafgfileefdlnidtfinnfdkdkdliisnfmkkrdiyl<br>nrvldrgdnrlkniikeykfrdtedifcndrdnnlvklyilmyillpveirgdflgfvkknyydmkhvdfidkkdke<br>dkdtffhdlrlfeknirkleitdyslssgflskehkvdiekkindfinrngamklpeditieefnkslilpimknyqin<br>fkllndieisalfkiakdrsitfkqaideiknedikknskkndknnhkdkninftqlmkralhekipykagmyqir<br>nnishidmeqlyidplnsymnsnknnitiseqiekiidvcvtggvtgkelnnniindyymkkeklvfnlklrkqn<br>divsiesqeknkreefvfkkygldykdgeiniievíqkvnslqeelrniketskeklknketlfrdislingtirkninf<br>kikemvldivrmdeirhinihiyykgenytrsniikfkyaidgenkkyylkqheindinlelkdkfvtlicnmdkh<br>pnknkqtinlesnyiqnvkfiip |
| WP_0 40490 876 (SEQ ID NO: 317) | menkgnnkkidfdenynilvaqikeyftkeienynnridniidkkellkysekkeeseknkkleelnklksqklk<br>iltdeeikadvikiikifsdlrhslmhyeykyfenlfenkkneelaellnlnlfknltllrqmkienktnylegreefni<br>igknikakevlghynllaeqkngfnnfinsffvqdgtenlefkklidehfvnakkrlernikkskklekelekmeq<br>hyqrlncayvwdihtsttykklynkrkslieeynkqineikdkevitainvellrikkemeeitksnslfrlkykmq<br>iayafleiefggniakfkdefdcskmeevqkylkkgvkylkyykdkeaqknyefpfeeifenkdthneewlen<br>tsennlfkfyiltylllpmefkgdflgvvkkhyydiknvdftdesekelsqvqldkmigdsffhkirlfekntkryeii<br>kysiltsdeikryfrlleldvpyfeyekgtdeigifnkniiltifkyyqiifr-<br>lyndleihglfnissdldkilrdlksygnkn<br>infreflyvikqnnnssteeeyrkiwenleakylrlhlltpekeeiktktkeeleklneisnlrngichlnykeiieeil<br>kteiseknkeatlnekirkvinfikeneldkvelgfnfindffmkkeqfmfgqikqvkegnsdsittererkekn<br>nkklketyelncdnlsefyetsnnlreranssslledsaflkkiglykvknnkvnskvkdeekrienikrkllkdssd<br>imgmykaevvkklkeklililfkhdeekriyvtvydtskavpeniskeilvkrnnskeeyffedknnkkyvteyytl<br>eitetnelkvipakklegkefkteknkenklmlnnhycfnvkiiy |
| WP_0 47396 607 (SEQ ID NO: 318) | meeikhkknkssiirvivsnydmtgikeikvlyqkqggvdtfnlktiinlesgnleiisckpkerekyryefnckte<br>intisitkkdkvlkkeirkyslelyfknekkdtvvakvtdllkapdkiegernhlrklsssterkllsktlcknyseiskt<br>pieeidsikiykikrflnyrsnfliyfalindflcagvkeddinevwliqdkehtaflenriekitdyifdklskdienk<br>knqfekrikkykt sleelktetleknktfyidsiktkitnlenkitelslynskeslkedlikiisiftnlrhslmhydyks<br>fenlfenieneelknlldlnlfksirmsdefktknrtnyldgtesftivkkhqnlkklytyynnlcdkkngfntfinsf<br>fvtdgientdfknliilhfekemeeykksieyykikisneknkskkeklkekidllqselinmrehknllkqiyffdi<br>hnsikykelyserknlieqynlqingvkdvtainhintkllslknkmdkitkqnslyrlkyklkiaysflmiefdgdv<br>skfknnfdptnlekrveyldkkeeylnytapknkfnfakleeelqkiqstsemgadylnvspennlfkfyiltyi<br>mlpvefkgdflgfvknhyyniknvdfmdeslldenevdsnklnekienlkdssffnkirlfeknikkyeivkysv<br>stqenmkeyfkqlnldipyldykstdeigifnknmilpifkyyqnvfklcndieihallalankkqqnleyaiyccs<br>kknslnynellktfnrktyqnlsfirnkiahlnykelfsdlfnneldlntkvrcliefsqnnkfdqidlgmnfindyy<br>mkktrfifnqrrlrdlnvpskekiidgkrkqqndsnnellkkyglsrtnikdifnkawy |
| WP_0 35935 671 (SEQ ID NO: 319) | mkvryrkqaqldtfiikteivnndifiksiiekarekyrysflfdgeekyhfknkssveivkndifsqtpdnmirny<br>kitlkiseknprvveaeiedlmnstilkdgrrsarreksmterklieekvaenysllancpieevdsikiykikrflty<br>rsnmllyfasinsflcegikgkdneteeiwhlkdndvrkekvkenfknkliqstenynsslknqieekeklsskef<br>kkgafyrtiikklqqerikelsekssltedcekiiklyselrhplmhydyqyfenlfenkenseltknlnldifkslplvr<br>kmklnnkvnylednd tlfvlqktkkaktlyqiydalceqkngfnkfindffvsdgeentvfkqiinekfqsemef<br>lekrisesekkneklkkkldsmkahfrninsedtkeayfwdihssrnyktkynerknlvneytkllgsskekkllr<br>eeitkinrqllklkqemeeitkknslfrleykmkiafgflfcefdgniskfkdefdasnqekiiqyhkngekyltsfl<br>keeekekfnlekmqkiiqkteeedwllpetknnlfkfylltylllpyelkgdflgfvkkhyydiknvdfmdenqn<br>niqvsqtvekqedyfyhkirlfekntkkyeivkysivpneklkqyfedlgidikyltgsvesgekwlgenlgidiky<br>ltveqksevseeknkkvslknngmfnktillfvfkyyqiafklfndielyslfflreksekpfevfleelkdkmigkql<br>nfgqllyvvyevlvknkdldkilskkidyrkdksfspeiaylrnflshlnyskfldnfmkintnksdenkevlipsiki<br>qkmiqfiekcnlqnqidfdfnfvndfymrkekmffiqlkqifpdinstekqkksekeeilrkryhlinkkneqik<br>deheaqsqlyekilslqkifscdknnfyrrlkeekllflekqgkkkismkeikdkiasdisdllgilkkeitrdikdklt<br>ekfryceekllnisfynhqdkkkeegirvflirdknsdnfkfesilddgsnkifiskngkeitiqccdkvletlmiek<br>ntlkissngkiisliphysysidvky |
| WP_0 35906 563 (SEQ ID NO: 320) | mekfrrqnrssiikiiisnydtkgikelkvryrkqaqldtfiikteivnndifiksiiekarekyrysflfdgeekyhfk<br>nkssveivkkdifsqtpdnmirnykitlkiseknprvveaeiedlmnstilkdgrrsarreksmterklieekvae<br>nysllancpmeevdsikiykikrfltyrsnmllyfasinsflcegikgkdneteeiwhlkdndvrkekvkenfknk<br>liqstenynsslknqieekekllrkeskkgafyrtiikklqqerikelsekssltedcekiiklyselrhplmhydyqyf<br>enlfenkenseltknlnldifkslplvrkmklnnkvnylednd tlfvlqktkkaktlyqiydalceqkngfnkfind<br>ffvsdgeentvfkqiinekfqseieflekrisesekkneklkkkldsmkahfrninsedtkeayfwdihssrnykt<br>kynerknlvneytellgsskekkllreeitkinrqllklkqemeeitkknslfrleykmkmafgflfcefdgnisrfk<br>defdasnqekiiqyhkngekyltyflkeeekekfnlkklqetiqktgeenwllpqnknnlfkfylltylllpyelkg<br>dflgfvkkhyydiknvdfmdenqsskiieskeddfyhkirlfekntkkyeivkysivpdkklkqyfkdlgidtkyli<br>ldqksevsgeknkkvslknngmfnktillfvfkyyqiafklfndielyslfflreksgkpfevflkelkdkmigkqlnf<br>gqllyvvyevlvknkdlseilseridyrkdmcfsaeiadlrnflshnyskfldnfmkintnksdenkevlipsikiq<br>kmikfieecnlqsqidfdfnfvndfymrkekmffiqlkqifpdinstekqkmnekeeilrnryhltdkkneqik<br>deheaqsqlyekilslqkiyssdknnfygrlkeekllflekqekkklsmeeikdkiagdisdllgilkkeitrdikdkl |

TABLE 4B-continued

| Name | sequence |
|---|---|
| | tekfryceekllnlsfynhqdkkkeesirvflirdknsdnfkfesilddgsnkifiskngkeitiqccdkvletliiekn<br>tlkissngkiisliphysysidvky |
| WP_042678931 (SEQ ID NO: 321) | mksgrrekaksnkssivrviisnfddkqvkeikvlytkqggidvikfkstekdekgrmkfnfdcaynrleeeefn<br>sfggkgkqsffvttnedltelhvtkrhkttgeiikdytiqgkytpikqdrtkvtvsitdnkdhfdsndlgdkirlsrsl<br>tqytnrilldadvmknyreivcsdsekvdetinidsqeiykinrflsyrsnmiiyyqminnfllhydgeedkggn<br>dsinlineiwkyenkkndekekiiersyksieksinqyilnhntevesgdkekkidiseerikedlkktfilfsrlrh<br>ymvhynykfyenlysgknfiiynkdksksrrfselldlnifkelskiklvknravsnyldkkttihvlnkninaiklldi<br>yrdicetkngfnnfinnmmtisgeedkeykemvtkhfnenmnklsiylenfkkhsdfktnnkkketynllkq<br>eldeqkklrlwfnapyvydihsskkykelyverkkyvdihsklieaginndnkkklneinvklcelntemkemt<br>klnskyrlqyklqlafgfileefnldidkfvsafdkdnnltiskfmekretylsksldrrdnrfkklikdykfrdtedif<br>csdrennlvklyilmyillpveirgdflgfvkknyydlkhvdfidkrnndnkdtffhdlrlfeknvkrlevtsyslsdg<br>flgkksrekfgkelekfiyknvsialptnidikefnkslvlpmmknyqiifkllndieisalfliakkegnegsitfkkv<br>idkvrkedmngninfsqvmkmalnekvncqirnsiahinmkqlyieplniyinnnqnkktiseqmeeiidici<br>tkgltgkelnkniindyymkkeklvfnlklrkrnnlvsidaqqknmkeksilnkydlnykdenlnikeiilkvndl<br>nnkqkllkettegesnyknalskdilllngiirkninfkikemilgiiqqneyryvniniydkirkedhnidlkinnk<br>yieiscyenksnestderinfkikymdlkvknellvpscyediyikkkidleiryienckvvyidiyykkyninlefd<br>gktlfvkfnkdvkknnqkvnlesnyiqnikfivs |
| WP_062627846 (SEQ ID NO: 322) | mekfrrqnrnsiikiiisnydtkgikelkvryrkqaqldtfiikteivnndifiksiiekarekyrysflfdgeekyhfk<br>nkssveivkkdifsqtpdnmirnykitlkiseknprvveaeiedlmnstilkdgrrsarreksvterklieekvae<br>nysllancpmeevdsikiykikrfltyrsnmllyfasinsflcegikgkeneteeiwhlkdndvrkekvkenfknk<br>liqstenynsslknqieekekllrkeskkgafyrtiikklqqerikelseksltedcekiiklysklrhslmhydyqyf<br>enlfenketpelkdkldlhlfkslplirkmklnnkvnyledgdtlfvlqktkkaktlyqiydalceqkngfnkfindf<br>fvsdgeentvfkqiinekfqsemeflgkriseseeknpklkkkfdsmkahfhninsedtkeayfwdihsssny<br>ktkynerknlvneytellgsskekkllreeitqinrklllklkqemeeitkknslfrleykmkmafgflfcefdgnisr<br>fkdefdasnqekiiqyhkngekyltyflkeeekekfnlkklqetiqktgkenwllpqnknnlfkfylltylllpyelk<br>gdflgfvkkhyydiknvdfmdenqsskiieskeddfyhkirlfekntkkyeivkysivpdeklkqyfkdlgidtky<br>lileqksevsgeknkkvslknngmfnktillfvfkyyqiafklfndielyslfflreksgkpfevflkelkdkmigkql<br>nfgqllyviyevlvknkdlseilseridyrkdmcfsaeiadlrnflshlnyskfldnfmkintnksdenkevlipsiki<br>qkmikfieecnlqsqidfdfnfvndfymrkekmffiqlkqifpdinstekqkmnekeeilrnryhltdkkneqi<br>kdeheaqsqlyekilslqkiyssdknnfygrlkeekllflgkqgkkklsmeeikdkiagdisdllgilkkeitrdikdk<br>ltekfryceekllnlsfynhqdkkkeesirvflirdknsdnfkfesilddgsnkifiskngkeitiqccdkvletlmie<br>kntlkissngkiislvphysysidvky |
| WP_005959231 (SEQ ID NO: 323) | mekfrrqnrnsiikiiisnydtkgikelkvryrkqaqldtfiikteivnndifiksiiekarekyrysflfdgeekyhfk<br>nkssveivkkdifsqtpdnmirnykitlkiseknprvveaeiedlmnstilkdgrrsarreksmterklieekvak<br>nysllancpmeevdsikiykikrfltyrsnmllyfasinsflcegikgkdneteeiwhlkdndvrkekvrenfknk<br>liqstenynsslknqieekekllrkefkkgafyrtiikklqqerikelseksltedcekiiklysklrhslmhydyqyf<br>enlfenkknddlmkdlnldlfkslplirkmklnnkvnyledgdtlfvlqktkkaktlyqiydalceqkngfnkfin<br>dffvsdgeentvfkqiinekfqsemeflekrisesekkneklkkkldsmkahfrninsedtkeayfwdihssrn<br>yktkynerknlvneytellgsskekkllreeitkinrqllklkqemeeitkknslfrleykmkiafgflfcefdgnisk<br>fkdefdasnqekiiqyhkngekyltsflkeeekekfnlekmqkiiqkteeedwllpetknnlfkfylltylllpyel<br>kgdflgfvkkhyydiknvdfidenqnniqvsqtvekqedyfyhkirlfekntkkyeivkysivpneklkqyfedl<br>gidikyltveqksevseeknkkvslknngmfnktillfvfkyyqiafklfndielyslfflreksgkpleifrkelesk<br>mkdgylnfgqllyvvyevlvknkdldkilskkidyrkdksfspeiaylrnflshlnyskfldnfmkintnksdenk<br>evlipsikiqkmiqfiekcnlqnqidfdfnfvndfymrkekmffiqlkqifpdinstekqkmnekeeilrnryhlt<br>dkkneqikdeheaqsqlyekilslqkiyssdknnfygrlkeekllflekqgkkklsmeeikdkiagdisdllgilkk<br>eitrdikdkltekfryceekllnlsfynhqdkkkeesirvflirdknsdnfkfesilddgsnkifiskngkeitiqccdk<br>vletliiekntlkissngkiisliphysysidvky |
| WP_027128616 (SEQ ID NO: 324) | mgkpnrssiikiiisnydnkgikevkvrynkqaqldtflikselkdgkfilysivdkarekyrysfeidktninkneil<br>iikkdiysnkedkvirkyilsfevseknrdrtivtkikdcletqkkekferentrrliseterkllseetqktyskiaccs<br>pedidsvkiykikrylayrsnmllffslindifvkgvvkdngeevgeiwriidskeidekktydllvenfkkrmsqe<br>finykqsienkiekntnkikeieqklkkekykkeinrlkkqlielnrendllekdkielsdeeirediekilkiysdlr<br>hklmhynyqyfenlfenkkiskeknedvnltelldlnlfrylplvrqlklenktnylekedkitvlgvsdsaikyys<br>yynflceqkngfnnfinsffsndgeenksfkekinlslekeieimeketnekikeinknelqlmkeqkelgtayv<br>ldihslndykishnernknvklqndimngnrdknaldkinkklvelkikmdkitkrnsilrlkyklqvaygflme<br>eykgnikkfkdefdiskekiksykskgekylevksekkyitkilnsiedihnitwlknqeennlfkfyvltyillpfef<br>rgdflgfvkkhyydiknvefldenndrltpeqlekmkndsffnkirlfeknskkydilkesiltserigkyfsllntga<br>kyfeyggeenrgifnkniiipifkyyqivlklyndvelamlltlsesdekdinkikelvtlkekvspkkidyekkykf<br>svlldcfnriinlgkkdflaseevkevaktftnlaylrnkichlnyskfiddlltidtnk-<br>sttdsegklllindrirklikfire<br>nnqkmnisidynyindyymkkekfifgqrkqaktiidsgkkankrnkaeellkmyrvkkeninliyelskklne<br>ltkselflldkkllkdidftdvkiknksffelkndvkevanikqalqkhsseligiykkevimaikrsivskliydeekv<br>lsiiiydktnkkyedflleirrerdinkfqflidekkeklgyekiietkekkkvvvkiqnnselvsepriiknkdkkka<br>ktpeeisklgildltnhycfnlkitl |
| WP_062624740 (SEQ ID NO: 325) | mekfrrqnrnsiikiiisnydtkgikelkvryrkqaqldtfiikteivnndifiksiiekarekyrysflfdgeekyhfk<br>nkssveivkkdifsqtpdnmirnykitlkiseknprvveaeiedlmnstilkdgrrsarreksmterklieekvak<br>nysllancpmeevdsikiykikrfltyrsnmllyfasinsflcegikgkdneteeiwhlkdndvrkekvrenfknk<br>liqstenynsslknqieekekllrkefkkgafyrtiikklqqerikelseksltedcekiiklysklrhslmhydyqyf<br>enlfenkknddlmkdlnldlfkslplirkmklnnkvnyledgdtlfvlqktkkaktlyqiydalceqkngfnkfin<br>dffvsdgeentvfkqiinekfqsemeflekrisesekkneklkkkldsmkahfrninsedtkeayfwdihssrn<br>yktkynerknlvneytellgsskekkllreeitkinrqllklkqemeeitkknslfrleykmkiafgflfcefdgnisk<br>fkdefdasnqekiiqyhkngekyltsflkeeekekfnlekmqkiiqkteeedwllpetknnlfkfylltylllpyel<br>kgdflgfvkkhyydiknvdfidenqnniqvsqtvekqedyfyhkirlfekntkkyeivkysivpneklkqyfedl<br>gidikyltgsvesgekwlgenlgidikyltveqksevseeknkkvslknngmfnktillfvfkyyqiafklfndiely |

TABLE 4B-continued

| Name | sequence |
|---|---|
| | slfflreksgkpleifrkeleskmkdgylnfgqllyvvyevlvknkdldkilskkidyrkdksfspeiaylrnflshlny skfldnfmkintnksdenkevlipsikiqkmiqfiekcnlqnqidfdfnfvndfymrkekmffiqlkqifpdinst ekqkmnekeeilrnryhltdkkneqikdeheaqsqlyekilslqkiyssdknnfygrlkeekllflekqgkkkls meeikdkiagdisdllgilkkeitrdikdkltekfryceekllnlsfynhqdkkkeesirvflirdknsdnfkfesildd gsnkifiskngkeitiqccdkvletliiekntlkissngkiisliphysysidvky |
| WP_0 96402 050 (SEQ ID NO: 326) | menknkpnrgsivriiisnydmkgikelkvryrkqaqldtfilqttldksnnsilindfrvkarekyrysftydgke kfsvpsnsiivtkidnaapekskeirkykitlgidekcktgsmitaaiedlleddrvregirnprrkaskterklites ichnyaqitqcpveeidavkiykvkrflsyrsnmllffalindflcknlknekgekineiwemenkgnnkkidfd enynilvaqikeyftkeienynnridniidkkellkyseekeeseknkkleelnklesqklkiltdeeikadvikiiki fsdlrhslmhyeykyfenlfenkkneelaellnlnlfknltllrqmkienktnylegdekfnilgkdvraknalghy dllveqkngfnnfinsffvqdgtenlefkkfidenfikaqkeleedikncke svkklekklkenpkksedlekkle kkqkklkelkkelekmkqhykrlncayvwdihsstvykklynerknliekynkqlnglqdknaitginaqllrik kemeeitksnslfrlkykmqiayaflemeyegniakfknefdcsktekiqewlekseeylnycmekeedgkn ykfhfkeiseikdthneewlentsennlfkfyiltylllpmefkgdflgvvkkhyydiknvdftdesekelsqeqi dkmigdsffhkirlfekntkryeiikysiltsdeikkyfellelkvpyleykgideigifnkniilpifkyyqiifrlyndle ihglfnvsfdinkilsdlksygneninfreflyvikqnnnssteeeyqkiwekleskylkeplltpekkeinkktek elkkldgisflrnkishleyekiiegvlktavngenkktsetnadkvflnekikkiinfikeneldkielgfnfindff mkkeqfmfgqikqvkegnsdsitterkrkeennkrlkityglnynnlskiyefsntlreivnsplflkdstllkkvdl skvmlkekpicslqyenntkleddikrillkdssdimgiykaevvkkllkeklvlifkydeekkiyvtvydtskavp eniskeilvkrnnskeeyffednkkkyttqyytleitkenelkvipakklegkefktekkeenklmlnnhycfnv kiiy |

In some embodiments, the Cas13 protein is a Cas13d protein. Yan et al. Molecular Cell, 70, 327-339 (2018).

In some embodiments, the components of the AD-functionalized CRISPR-Cas system may be delivered in various form, such as combinations of DNA/RNA or RNA/RNA or protein RNA. For example, the Cas13 protein may be delivered as a DNA-coding polynucleotide or an RNA-coding polynucleotide or as a protein. The guide may be delivered may be delivered as a DNA-coding polynucleotide or an RNA. All possible combinations are envisioned, including mixed forms of delivery.

Delivery

In some embodiments, the components of the CD-functionalized CRISPR-Cas system may be delivered in various form, such as combinations of DNA/RNA or RNA/RNA or protein RNA. For example, the Cas13 protein may be delivered as a DNA-coding polynucleotide or an RNA-coding polynucleotide or as a protein. The guide may be delivered may be delivered as a DNA-coding polynucleotide or an RNA. All possible combinations are envisioned, including mixed forms of delivery.

In some aspects, the invention provides methods comprising delivering one or more polynucleotides, such as or one or more vectors as described herein, one or more transcripts thereof, and/or one or proteins transcribed therefrom, to a host cell.

Vectors

In general, the term "vector" refers to a nucleic acid molecule capable of transporting another nucleic acid to which it has been linked. It is a replicon, such as a plasmid, phage, or cosmid, into which another DNA segment may be inserted so as to bring about the replication of the inserted segment. Generally, a vector is capable of replication when associated with the proper control elementsVectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adeno-viruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells.

With regards to recombination and cloning methods, mention is made of U.S. patent application Ser. No. 10/815,730, published Sep. 2, 2004 as US 2004-0171156 A1, the contents of which are herein incorporated by reference in their entirety.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Advantageous vectors include lentiviruses and adeno-associated viruses, and types of such vectors can also be selected for targeting particular types of cells.

In particular embodiments, use is made of bicistronic vectors for the guide RNA and (optionally modified or mutated) the CRISPR-Cas protein fused to cytidine deaminase. Bicistronic expression vectors for guide RNA and (optionally modified or mutated) CRISPR-Cas protein fused to cytidine deaminase are preferred. In general and particularly in this embodiment, (optionally modified or mutated) CRISPR-Cas protein fused to cytidine deaminase is preferably driven by the CBh promoter. The RNA may preferably be driven by a Pol III promoter, such as a U6 promoter. Ideally the two are combined.

Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67:31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces* cerivisae include pYepSecl (Baldari, et al., 1987. EMBO J. 6:229-234), pMFa (Kuijan and Herskowitz, 1982. Cell 30:933-943), pJRY88 (Schultz et al., 1987. Gene 54:113-123), pYES2 (Invitrogen Corporation, San Diego, Calif.), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3:2156-2165) and the pVL series (Lucklow and Summers, 1989. Virology 170:31-39).

In some embodiments, a vector is capable of driving expression of one or more sequences in mammalian cells using a mammalian expression vector. Examples of mammalian expression vectors include pCDM8 (Seed, 1987. Nature 329:840) and pMT2PC (Kaufman, et al., 1987.

EMBO J. 6:187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1:268-277), lymphoid-specific promoters (Calame and Eaton, 1988. *Adv. Immunol.* 43:235-275), in particular promoters of T cell receptors (Winoto and Baltimore, 1989. *EMBO J.* 8:729-733) and immunoglobulins (Baneiji, et al., 1983. *Cell* 33:729-740; Queen and Baltimore, 1983. *Cell* 33:741-748), neuron-specific promoters (e.g., the neurofilament promoter; Byrne and Ruddle, 1989. *Proc. Natl. Acad. Sci. USA* 86:5473-5477), pancreas-specific promoters (Edlund, et al., 1985. *Science* 230:912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249:374-379) and the α-fetoprotein promoter (Campes and Tilghman, 1989. *Genes Dev.* 3:537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element is operably linked to one or more elements of a CRISPR system so as to drive expression of the one or more elements of the CRISPR system.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteins or has cells containing nucleic acid-targeting effector proteins, such as by way of prior administration thereto of a vector or vectors that code for and express in vivo nucleic acid-targeting effector proteins. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a a nucleic acid-targeting effector protein. Nucleic acid-targeting effector protein or nucleic acid-targeting guide RNA or RNA(s) can be delivered separately; and advantageously at least one of these is delivered via a particle complex. nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome modification.

Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10): 1149-1154 (1988); Vigne, Restorative Neurology and Neuroscience 8:35-36 (1995); Kremer & Perricaudet, British Medical Bulletin 51(1): 31-44 (1995); Haddada et al., in Current Topics in Microbiology and Immunology, Doerfler and Böhm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g., in vitro or ex vivo administration) or target tissues (e.g. in vivo administration).

Plasmid delivery involves the cloning of a guide RNA into a CRISPR-Cas protein expressing plasmid and transfecting the DNA in cell culture. Plasmid backbones are available commercially and no specific equipment is required. They have the advantage of being modular, capable of carrying different sizes of CRISPR-Cas coding sequences (including those encoding larger sized proteins) as well as selection markers. Both an advantage of plasmids is that they can ensure transient, but sustained expression. However, delivery of plasmids is not straightforward such that in vivo efficiency is often low. The sustained expression can also be disadvantageous in that it can increase off-target editing. In addition, excess build-up of the CRISPR-Cas protein can be toxic to the cells. Finally, plasmids always hold the risk of random integration of the dsDNA in the host genome, more particularly in view of the double-stranded breaks being generated (on and off-target).

The preparation of lipid: nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787). This is discussed more in detail below.

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

The invention provides AAV that contains or consists essentially of an exogenous nucleic acid molecule encoding a CRISPR system, e.g., a plurality of cassettes comprising or consisting a first cassette comprising or consisting essentially of a promoter, a nucleic acid molecule encoding a CRISPR-associated (Cas) protein (putative nuclease or helicase proteins), e.g., Cas13 and a terminator, and one or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator. . . . Promoter-gRNA (N)-terminator, where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., Cas (Cas13) and a terminator, and a second rAAV containing one or more cassettes each comprising or consisting essentially of a promoter, nucleic acid molecule encoding guide RNA (gRNA) and a terminator (e.g., each cassette schematically represented as Promoter-gRNA1-terminator, Promoter-gRNA2-terminator. . . . Promoter-gRNA (N)-terminator, where N is a number that can be inserted that is at an upper limit of the packaging size limit of the vector). Alternatively, because Cas13 can process its own crRNA/gRNA, a single crRNA/gRNA array can be used for multiplex gene editing. Hence, instead of including multiple cassettes to deliver the gRNAs, the rAAV may contain a single cassette comprising or consisting essentially of a promoter, a plurality of crRNA/gRNA, and a terminator (e.g., schematically represented as Promoter-gRNA1-gRNA2 . . . gRNA (N)-terminator, where N is a number that can be inserted that is at an upper limit of the packaging size limit of the vector). See Zetsche et al *Nature Biotechnology* 35, 31-34 (2017), which is incorporated herein by reference in its entirety. As rAAV is a DNA virus, the nucleic acid molecules in the herein discussion concerning AAV or rAAV are advantageously DNA. The promoter is in some embodiments advantageously human Synapsin I promoter (hSyn). Additional methods for the delivery of nucleic acids to cells are known to those skilled in the art. See, for example, US20030087817, incorporated herein by reference.

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral.

In some embodiments, a host cell is transiently or non-transiently transfected with one or more vectors described herein. In some embodiments, a cell is transfected as it naturally occurs in a subject optionally to be reintroduced therein. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, CIR, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In particular embodiments, transient expression and/or presence of one or more of the components of the CD-functionalized CRISPR system can be of interest, such as to reduce off-target effects. In some embodiments, a cell transfected with one or more vectors described herein is used to establish a new cell line comprising one or more vector-derived sequences. In some embodiments, a cell transiently transfected with the components of a CD-functionalized CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments it is envisaged to introduce the RNA and/or protein directly to the host cell. For instance, the CRISPR-Cas protein can be delivered as encoding mRNA together with an in vitro transcribed guide RNA. Such methods can reduce the time to ensure effect of the CRISPR-Cas protein and further prevents long-term expression of the CRISPR system components.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9:210-216; Sorensen et al., J. Mol. Biol. 2003, 327:761-766; Lewis et al., Nat. Gen. 2002, 32:107-108 and Simeoni et al., NAR 2003, 31, 11:2717-2724) and may be applied to the present invention.

siRNA has recently been successfully used for inhibition of gene expression in primates (see for example. Tolentino et al., Retina 24(4): 660 which may also be applied to the present invention.

Indeed, RNA delivery is a useful method of in vivo delivery. It is possible to deliver Cas13, cytidine deaminase, and guide RNA into cells using liposomes or nanoparticles. Thus delivery of the CRISPR-Cas protein, such as a Cas13, the delivery of the cytidine deaminase (which may be fused to the CRISPR-Cas protein or an adaptor protein), and/or delivery of the RNAs of the invention may be in RNA form and via microvesicles, liposomes or particle or particles. For example, Cas13 mRNA, cytidine deaminase mRNA, and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19:3112-3118, 2010) or exosomes (Schroeder, A., Levins, C., Cortez, C., Langer, R., and Anderson, D., Lipid-based nanotherapeutics for siRNA delivery, Journal of Internal Medicine, 267:9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12): 2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purified and characterized from transfected cell supernatant, then RNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 μmol of CRISPR Cas targeted to the brain may be contemplated. Zou et al. (HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 μl of a recombinant lentivirus having a titer of $1\times10^9$ transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1\times10^9$ transducing units (TU)/ml may be contemplated.

Dosage of Vectors

In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^0$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to 1×1050 genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg per 70 kg individual. Plasmids of the invention will generally comprise (i) a promoter; (ii) a sequence encoding a CRISPR-Cas protein, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

The dosage used for the compositions provided herein include dosages for repeated administration or repeat dosing. In particular embodiments, the administration is repeated within a period of several weeks, months, or years. Suitable assays can be performed to obtain an optimal dosage regime. Repeated administration can allow the use of lower dosage, which can positively affect off-target modifications.

RNA Delivery

In particular embodiments, RNA based delivery is used. In these embodiments, mRNA of the CRISPR-Cas protein, mRNA of the cytidine deaminase (which may be fused to a CRISPR-Cas protein or an adaptor), are delivered together with in vitro transcribed guide RNA. Liang et al. describes efficient genome editing using RNA based delivery (Protein Cell. 2015 May; 6(5): 363-372). In some embodiments, the mRNA(s) encoding Cas13 and/or cytidine deaminase can be chemically modified, which may lead to improved activity compared to plasmid-encoded Cas13 and/or cytidine deaminase. For example, uridines in the mRNA(s) can be partially or fully substituted with pseudouridine (Ψ), N1-methylpseudouridine ($me^1\Psi$), 5-methoxyuridine (5moU). See Li et al., Nature Biomedical Engineering 1, 0066 DOI: 10.1038/s41551-017-0066 (2017), which is incorporated herein by reference in its entirety.

RNP

In particular embodiments, pre-complexed guide RNA, CRISPR-Cas protein, and cytidine deaminase (which may be fused to a CRISPR-Cas protein or an adaptor) are delived as a ribonucleoprotein (RNP). RNPs have the advantage that they lead to rapid editing effects even more so than the RNA method because this process avoids the need for transcription. An important advantage is that both RNP delivery is transient, reducing off-target effects and toxicity issues. Efficient genome editing in different cell types has been observed by Kim et al. (2014, Genome Res. 24(6): 1012-9), Paix et al. (2015, Genetics 204(1): 47-54), Chu et al. (2016, BMC Biotechnol. 16:4), and Wang et al. (2013, Cell. 9; 153(4): 910-8).

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly, these polypeptides can be used for the delivery of CRISPR-effector based RNPs in eukaryotic cells.

Particles

In some aspects or embodiments, a composition comprising a delivery particle formulation may be used. In some aspects or embodiments, the formulation comprises a CRISPR complex, the complex comprising a CRISPR protein and a guide which directs sequence-specific binding of the CRISPR complex to a target sequence. In some embodiments, the delivery particle comprises a lipid-based particle, optionally a lipid nanoparticle, or cationic lipid and optionally biodegradable polymer. In some embodiments, the cationic lipid comprises 1,2-dioleoyl-3-trimethylammonium-propane (DOTAP). In some embodiments, the hydrophilic polymer comprises ethylene glycol or polyethylene glycol. In some embodiments, the delivery particle further comprises a lipoprotein, preferably cholesterol. In some embodiments, the delivery particles are less than 500 nm in diameter, optionally less than 250 nm in diameter, optionally less than 100 nm in diameter, optionally about 35 nm to about 60 nm in diameter.

Example particle delivery complexes are further disclosed in U.S. Provisional Application entitled "Nove Delivery of Large Payloads" filed 62/485,625 filed Apr. 14, 2017.

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g., diameter) of less than 100 microns (μm). In some embodiments, inventive particles have a greatest dimension of less than 10 u m. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

In terms of this invention, it is preferred to have one or more components of CRISPR complex, e.g., CRISPR-Cas protein or mRNA, or cytidine deaminase (which may be fused to a CRISPR-Cas protein or an adaptor) or mRNA, or guide RNA delivered using nanoparticles or lipid envelopes. Other delivery systems or vectors are may be used in conjunction with the nanoparticle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, nanoparticles of the invention have a greatest dimension of 100 nm or less. In other preferred embodiments, nanoparticles of the invention have a greatest dimension ranging between 35 nm and 60 nm. It will be appreciated that reference made herein to particles or nanoparticles can be interchangeable, where appropriate.

It will be understood that the size of the particle will differ depending as to whether it is measured before or after loading. Accordingly, in particular embodiments, the term "nanoparticles" may apply only to the particles pre loading.

Nanoparticles encompassed in the present invention may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft nanoparticles have been manufactured, and are within the scope of the present invention. A prototype nanoparticle of semi-solid nature is the liposome. Various types of liposome nanoparticles are currently used clinically as delivery systems for anticancer drugs and vaccines. Nanoparticles with one half hydrophilic and the other half hydrophobic are termed Janus particles and are particularly effective for stabilizing emulsions. They can self-assemble at water/oil interfaces and act as solid surfactants.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarization interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR-Cas protein or mRNA, cytidine deaminase (which may be fused to a CRISPR-Cas protein or an adaptor) or mRNA, or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi: 10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

CRISPR-Cas protein mRNA, cytidine deaminase (which may be fused to a CRISPR-Cas protein or an adaptor) or mRNA, and guide RNA may be delivered simultaneously using particles or lipid envelopes; for instance, CRISPR-Cas protein and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi: 10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (e.g., a Type VI protein such as Cas13) mRNA and guide RNA may be delivered simultaneously using particles or lipid envelopes. Examples of suitable particles include but are not limited to those described in U.S. Pat. No. 9,301,923.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3): 774-87. doi: 10.1021/mp100390w. Epub 2011 Apr. 1) describes biodegradable core-shell structured nanoparticles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles/nanoparticles based on self assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1): 14-28; Lalatsa, A., et al. J Contr Rel, 2012. 161(2): 523-36; Lalatsa, A., et al., Mol Pharm, 2012. 9(6): 1665-80; Lalatsa, A., et al. Mol Pharm, 2012. 9(6): 1764-74; Garrett, N. L., et al. J Biophotonics, 2012. 5(5-6): 458-68; Garrett, N. L., et al. J Raman Spect, 2012. 43(5): 681-688; Ahmad, S., et al. J Royal Soc Interface 2010. 7: S423-33; Uchegbu, I. F. Expert Opin Drug Deliv, 2006. 3(5): 629-40; Qu, X., et al. Biomacromolecules, 2006. 7(12): 3452-9 and Uchegbu, I. F., et al. Int J Pharm, 2001. 224:185-199). Doses of about 5 mg/kg are contemplated, with single or multiple doses, depending on the target tissue.

In one embodiment, particles/nanoparticles that can deliver RNA to a cancer cell to stop tumor growth developed by Dan Anderson's lab at MIT may be used/and or adapted to the CD-functionalized CRISPR-Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32): 12881-6; Zhang et al., Adv Mater. 2013 Sep. 6; 25(33): 4641-5; Jiang et al., Nano Lett. 2013 Mar. 13; 13(3): 1059-64; Karagiannis et al., ACS Nano. 2012 Oct. 23; 6(10): 8484-7; Whitehead et al., ACS Nano. 2012 Aug. 28; 6(8): 6922-9 and Lee et al., Nat Nanotechnol. 2012 Jun. 3; 7(6): 389-93.

U.S. patent application No. 20110293703 relates to lipidoid compounds are also particularly useful in the administration of polynucleotides, which may be applied to deliver the CD-functionalized CRISPR-Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the CD-functionalized CRISPR-Cas system of the present invention.

Preassembled recombinant CRISPR-Cas complexes comprising Cas13, cytidine deaminase (which may be fused to Cas13 or an adaptor protein), and guide RNA may be transfected, for example by electroporation, resulting in high mutation rates and absence of detectable off-target mutations. Hur, J. K. et al, Targeted mutagenesis in mice by electroporation of Cas13 ribonucleoproteins, Nat Biotechnol. 2016 Jun. 6. doi: 10.1038/nbt.3596.

In terms of local delivery to the brain, this can be achieved in various ways. For instance, material can be delivered intrastriatally e.g. by injection. Injection can be performed stereotactically via a craniotomy.

In some embodiments, sugar-based particles may be used, for example GalNAc, as described herein and with reference to WO2014118272 (incorporated herein by reference) and Nair, J K et al., 2014, Journal of the American Chemical Society 136(49), 16958-16961) and the teaching herein, especially in respect of delivery applies to all particles unless otherwise apparent. This may be considered to be a sugar-based particle and further details on other particle delivery systems and/or formulations are provided herein. GalNAc can therefore be considered to be a particle in the sense of the other particles described herein, such that general uses and other considerations, for instance delivery of said particles, apply to GalNAc particles as well. A solution-phase conjugation strategy may for example be used to attach triantennary GalNAc clusters (mol. wt. ~2000) activated as PFP (pentafluorophenyl) esters onto 5'-hexylamino modified oligonucleotides (5'-HA ASOs, mol. wt. ~8000 Da; Østergaard et al., Bioconjugate Chem., 2015, 26(8), pp 1451-1455). Similarly, poly(acrylate) polymers have been described for in vivo nucleic acid delivery (see WO2013158141 incorporated herein by reference). In further alternative embodiments, pre-mixing CRISPR nanoparticles (or protein complexes) with naturally occurring serum proteins may be used in order to improve delivery (Akinc A et al, 2010, Molecular Therapy vol. 18 no. 7, 1357-1364).

Nanoclews

Further, the CD-functionalized CRISPR system may be delivered using nanoclews, for example as described in Sun W et al, Cocoon-like self-degradable DNA nanoclew for anticancer drug delivery., J Am Chem Soc. 2014 Oct. 22; 136(42): 14722-5. doi: 10.1021/ja5088024. Epub 2014 Oct. 13; or in Sun W et al, Self-Assembled DNA Nanoclews for the Efficient Delivery of CRISPR-Cas9 for Genome Editing., Angew Chem Int Ed Engl. 2015 Oct. 5; 54(41): 12029-33. doi: 10.1002/anie.201506030. Epub 2015 Aug. 27.

LNP

In some embodiments, delivery is by encapsulation of the Cas13 protein or mRNA form in a lipid particle such as an LNP. In some embodiments, therefore, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-220 December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-220 December 2011). A dosage of 1 μg/ml of LNP or CRISPR-Cas RNA in or associated with the LNP may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-220 December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-0-[2"-

(methoxypolyethyleneglycol 2000) succinoyl]-1,2-dimyristoyl-sn-glycol (PEG-S-DMG), and R-3-[(ω-methoxy-poly(ethylene glycol) 2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC:CHOL:PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may performed by dissolving lipid mixtures comprised of cationic lipid: DSPC:cholesterol:PEG-c-DOMG (40:10:40:10 molar ratio) in ethanol to a final lipid concentration of 10 mmol/1. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted nanoparticles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a CRISPR-Cas system or components thereof.

A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-μm syringe filter.

Spherical Nucleic Acid (SNA™) constructs and other nanoparticles (particularly gold nanoparticles) are also contemplated as a means to delivery CRISPR-Cas system to intended targets. Significant data show that AuraSense Therapeutics' Spherical Nucleic Acid (SNA™) constructs, based upon nucleic acid-functionalized gold nanoparticles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495: S14-S16, Choi et al., Proc. Natl. Acad. Sci. USA. 2013 110 (19): 7625-7630, Jensen et al., Sci. Transl. Med. 5, 209ra152 (2013) and Mirkin, et al., Small, 10:186-192.

Self-assembling nanoparticles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling nanoparticles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA nanoparticles may be formed by using cyclodextrin-containing polycations. Typically, nanoparticles were formed in water at a charge ratio of 3 (+/−) and an siRNA concentration of 0.5 g/liter. One percent of the adamantane-PEG molecules on the surface of the targeted nanoparticles were modified with Tf (adamantane-PEG-Tf). The nanoparticles were suspended in a 5% (wt/vol) glucose carrier solution for injection.

Davis et al. (Nature, Vol 464, 15 Apr. 2010) conducts a RNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These nanoparticles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumors, Davis et al. investigated biopsies from three patients from three different dosing cohorts; patients A, B and C, all of whom had metastatic melanoma and received CALAA-01 doses of 18, 24 and 30 mg $m^{-2}$ siRNA, respectively. Similar doses may also be contemplated for the CRISPR Cas system of the present invention. The delivery of the invention may be achieved with nanoparticles containing a linear, cyclodextrin-based polymer (CDP), a human transferrin protein (TF) targeting ligand displayed on the exterior of the nanoparticle to engage TF receptors (TFR) on the surface of the cancer cells and/or a hydrophilic polymer (for example, polyethylene glycol (PEG) used to promote nanoparticle stability in biological fluids).

U.S. Pat. No. 8,709,843, incorporated herein by reference, provides a drug delivery system for targeted delivery of therapeutic agent-containing particles to tissues, cells, and intracellular compartments. The invention provides targeted particles comprising comprising polymer conjugated to a surfactant, hydrophilic polymer or lipid. U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material. U.S. Pat. No. 5,855,913, incorporated herein by reference, provides a particulate composition having aerodynamically light particles having a tap density of less than 0.4 g/cm3 with a mean diameter of between 5 μm and 30 u m, incorporating a surfactant on the surface thereof for drug delivery to the pulmonary system. U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system. U.S. Pat. No. 5,543,158, incorporated herein by reference, provides biodegradable injectable particles having a biodegradable solid core containing a biologically active material and poly(alkylene glycol) moieties on the surface. WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such conjugated lipomers can be used in the context of the CRISPR-Cas system to achieve in vitro, ex vivo and in vivo genomic perturbations to modify gene expression, including modulation of protein expression.

In one embodiment, the nanoparticle may be epoxide-modified lipid-polymer, advantageously 7C1 (see, e.g., James E. Dahlman and Carmen Barnes et al. Nature Nanotechnology (2014) published online 11 May 2014, doi: 10.1038/nnano.2014.84). C71 was synthesized by reacting C15 epoxide-terminated lipids with PEI600 at a 14:1 molar ratio, and was formulated with C14PEG2000 to produce nanoparticles (diameter between 35 and 60 nm) that were stable in PBS solution for at least 40 days.

An epoxide-modified lipid-polymer may be utilized to deliver the CRISPR-Cas system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

In some embodiments, the LNP for deliverting the RNA molecules is prepared by methods known in the art, such as those described in, for example, WO 2005/105152 (PCT/EP2005/004920), WO 2006/069782 (PCT/EP2005/014074), WO 2007/121947 (PCT/EP2007/003496), and WO 2015/082080 (PCT/EP2014/003274), which are herein incorporated by reference. LNPs aimed specifically at the enhanced and improved delivery of siRNA into mammalian cells are described in, for example, Aleku et al., Cancer Res., 68(23): 9788-98 (Dec. 1, 2008), Strumberg et al., Int. J. Clin. Pharmacol. Ther., 50(1): 76-8 (January 2012), Schultheis et al., J. Clin. Oncol., 32(36): 4141-48 (Dec. 20, 2014), and Fehring et al., Mol. Ther., 22(4): 811-20 (Apr. 22, 2014), which are herein incorporated by reference and may be applied to the present technology.

In some embodiments, the LNP includes any LNP disclosed in WO 2005/105152 (PCT/EP2005/004920), WO 2006/069782 (PCT/EP2005/014074), WO 2007/121947 (PCT/EP2007/003496), and WO 2015/082080 (PCT/EP2014/003274).

In some embodiments, the LNP includes at least one lipid having Formula I:

(Formula I)

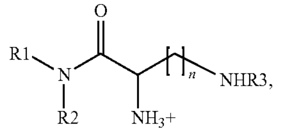

wherein R1 and R2 are each and independently selected from the group comprising alkyl, n is any integer between 1 and 4, and R3 is an acyl selected from the group comprising lysyl, ornithyl, 2,4-diaminobutyryl, histidyl and an acyl moiety according to Formula II:

(Formula II)

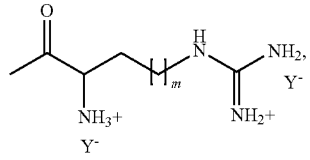

wherein m is any integer from 1 to 3 and $Y^-$ is a pharmaceutically acceptable anion. In some embodiments, a lipid according to Formula I includes at least two asymmetric C atoms. In some embodiments, enantiomers of Formula I include, but are not limited to, R—R; S—S; R—S and S—R enantiomer.

In some embodiments, R1 is lauryl and R2 is myristyl. In another embodiment, R1 is palmityl and R2 is oleyl. In some embodiments, m is 1 or 2. In some embodiments, $Y^-$ is selected from halogenids, acetate or trifluoroacetate.

In some embodiments, the LNP comprises one or more lipids select from: β-arginyl-2,3-diamino propionic acid-N-palmityl-N-oleyl-amide trihydrochloride (Formula III):

(Formula III)

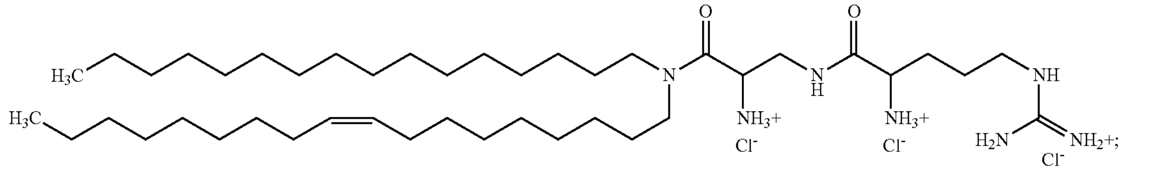

β-arginyl-2,3-diamino propionic acid-N-lauryl-N-myristyl-amide trihydrochloride (Formula IV):

(Formula IV)

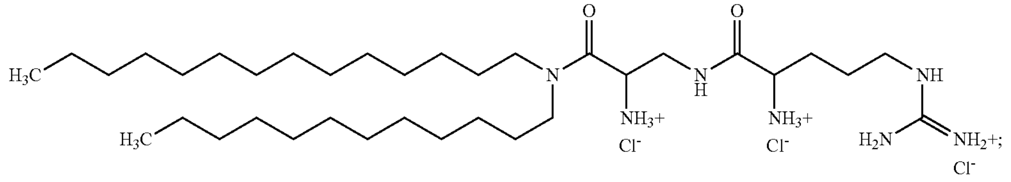

and ε-arginyl-lysine-N-lauryl-N-myristyl-amide trihydrochloride (Formula V):

(Formula V)

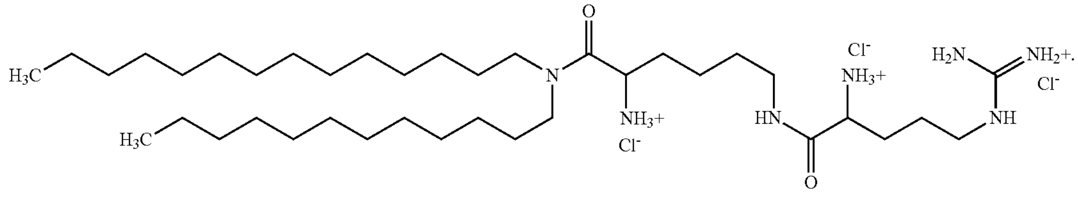

In some embodiments, the LNP also includes a constituent. By way of example, but not by way of limitation, in some embodiments, the constituent is selected from peptides, proteins, oligonucleotides, polynucleotides, nucleic acids, or a combination thereof. In some embodiments, the constituent is an antibody, e.g., a monoclonal antibody. In some embodiments, the constituent is a nucleic acid selected from, e.g., ribozymes, aptamers, spiegelmers, DNA, RNA, PNA, LNA, or a combination thereof. In some embodiments, the nucleic acid is guide RNA and/or mRNA.

In some embodiments, the constituent of the LNP comprises an mRNA encoding a CRIPSR-Cas protein. In some embodiments, the constituent of the LNP comprises an mRNA encoding a Type-II or Type-V CRIPSR-Cas protein. In some embodiments, the constituent of the LNP comprises an mRNA encoding a cytidine deaminase (which may be fused to a CRISPR-Cas protein or an adaptor protein).

In some embodiments, the constituent of the LNP further comprises one or more guide RNA. In some embodiments, the LNP is configured to deliver the aforementioned mRNA and guide RNA to vascular endothelium. In some embodiments, the LNP is configured to deliver the aforementioned mRNA and guide RNA to pulmonary endothelium. In some embodiments, the LNP is configured to deliver the aforementioned mRNA and guide RNA to liver. In some embodiments, the LNP is configured to deliver the aforementioned mRNA and guide RNA to lung. In some embodiments, the LNP is configured to deliver the aforementioned mRNA and guide RNA to hearts. In some embodiments, the LNP is configured to deliver the aforementioned mRNA and guide RNA to spleen. In some embodiments, the LNP is configured to deliver the aforementioned mRNA and guide RNA to kidney. In some embodiments, the LNP is configured to deliver the aforementioned mRNA and guide RNA to pancrea. In some embodiments, the LNP is configured to deliver the aforementioned mRNA and guide RNA to brain. In some embodiments, the LNP is configured to deliver the aforementioned mRNA and guide RNA to macrophages.

In some embodiments, the LNP also includes at least one helper lipid. In some embodiments, the helper lipid is selected from phospholipids and steroids. In some embodiments, the phospholipids are di- and/or monoester of the phosphoric acid. In some embodiments, the phospholipids are phosphoglycerides and/or sphingolipids. In some embodiments, the steroids are naturally occurring and/or synthetic compounds based on the partially hydrogenated cyclopenta[a]phenanthrene. In some embodiments, the steroids contain 21 to 30 C atoms. In some embodiments, the steroid is cholesterol. In some embodiments, the helper lipid is selected from 1,2-diphytanoyl-sn-glycero-3-phosphoethanolamine (DPhyPE), ceramide, and 1,2-dioleylsn-glycero-3-phosphoethanolamine (DOPE).

In some embodiments, the at least one helper lipid comprises a moiety selected from the group comprising a PEG moiety, a HEG moiety, a polyhydroxyethyl starch (polyHES) moiety and a polypropylene moiety. In some embodiments, the moiety has a molecule weight between about 500 to 10,000 Da or between about 2,000 to 5,000 Da. In some embodiments, the PEG moiety is selected from 1,2-distearoyl-sn-glycero-3 phosphoethanolamine, 1,2-dialkyl-sn-glycero-3-phosphoethanolamine, and Ceramide-PEG. In some embodiments, the PEG moiety has a molecular weight between about 500 to 10,000 Da or between about 2,000 to 5,000 Da. In some embodiments, the PEG moiety has a molecular weight of 2,000 Da.

In some embodiments, the helper lipid is between about 20 mol % to 80 mol % of the total lipid content of the composition. In some embodiments, the helper lipid component is between about 35 mol % to 65 mol % of the total lipid content of the LNP. In some embodiments, the LNP includes lipids at 50 mol % and the helper lipid at 50 mol % of the total lipid content of the LNP.

In some embodiments, the LNP includes any of β-3-arginyl-2,3-diaminopropionic acid-N-palmityl-N-oleyl-amide trihydrochloride, β-arginyl-2,3-diaminopropionic acid-N-lauryl-N-myristyl-amide trihydrochloride or β-arginyl-lysine-N-lauryl-N-myristyl-amide trihydrochloride in combination with DPhyPE, wherein the content of DPhyPE is about 80 mol %, 65 mol %, 50 mol % and 35 mol % of the overall lipid content of the LNP. In some embodiments, the LNP includes β-arginyl-2,3-diamino propionic acid-N-pahnityl-N-oleyl-amide trihydrochloride (lipid) and 1,2-diphytanoyl-sn-glycero-3-phosphoethanolamine (helper lipid). In some embodiments, the LNP includes β-arginyl-2,3-diamino propionic acid-N-palmityl-N-oleyl-amide trihydrochloride (lipid), 1,2-diphytanoyl-sn-glycero-3-phosphoethanolamine (first helper lipid), and 1,2-disteroyl-sn-glycero-3-phosphoethanolamine-PEG2000 (second helper lipid).

In some embodiments, the second helper lipid is between about 0.05 mol % to 4.9 mol % or between about 1 mol % to 3 mol % of the total lipid content. In some embodiments, the LNP includes lipids at between about 45 mol % to 50 mol % of the total lipid content, a first helper lipid between about 45 mol % to 50 mol % of the total lipid content, under the proviso that there is a PEGylated second helper lipid between about 0.1 mol % to 5 mol %, between about 1 mol % to 4 mol %, or at about 2 mol % of the total lipid content, wherein the sum of the content of the lipids, the first helper lipid, and of the second helper lipid is 100 mol % of the total lipid content and wherein the sum of the first helper lipid and the second helper lipid is 50 mol % of the total lipid content. In some embodiments, the LNP comprises: (a) 50 mol % of β-arginyl-2,3-diamino propionic acid-N-palmityl-N-oleyl-amide trihydrochloride, 48 mol % of 1,2-diphytanoyl-sn-glycero-3-phosphoethanolamine; and 2 mol % 1,2-distearoyl-sn-glycero-3-phosphoethanolamine-PEG2000; or (b) 50 mol % of β-arginyl-2,3-diamino propionic acid-N-palmityl-N-oleyl-amide trihydrocloride, 49 mol % 1,2-diphytanoyl-sn-glycero-3-phosphoethanolamine; and 1 mol % N(Carbonyl-methoxypolyethylenglycol-2000)-1,2-distearoyl-sn-glycero3-phosphoethanolamine, or a sodium salt thereof.

In some embodiments, the LNP contains a nucleic acid, wherein the charge ratio of nucleic acid backbone phosphates to cationic lipid nitrogen atoms is about 1:1.5-7 or about 1:4.

In some embodiments, the LNP also includes a shielding compound, which is removable from the lipid composition under in vivo conditions. In some embodiments, the shielding compound is a biologically inert compound. In some embodiments, the shielding compound does not carry any charge on its surface or on the molecule as such. In some embodiments, the shielding compounds are polyethylenglycoles (PEGs), hydroxyethylglucose (HEG) based polymers, polyhydroxyethyl starch (polyHES) and polypropylene. In some embodiments, the PEG, HEG, polyHES, and a polypropylene weight between about 500 to 10,000 Da or between about 2000 to 5000 Da. In some embodiments, the shielding compound is PEG2000 or PEG5000.

In some embodiments, the LNP includes at least one lipid, a first helper lipid, and a shielding compound that is removable from the lipid composition under in vivo conditions. In some embodiments, the LNP also includes a second helper lipid. In some embodiments, the first helper lipid is ceramide. In some embodiments, the second helper lipid is ceramide. In some embodiments, the ceramide comprises at least one short carbon chain substituent of from 6 to 10 carbon atoms. In some embodiments, the ceramide comprises 8 carbon atoms. In some embodiments, the shielding compound is attached to a ceramide. In some embodiments, the shielding compound is attached to a ceramide. In some embodiments, the shielding compound is covalently attached to the ceramide. In some embodiments, the shielding compound is attached to a nucleic acid in the LNP. In some embodiments, the shielding compound is covalently attached to the nucleic acid. In some embodiments, the shielding compound is attached to the nucleic acid by a linker. In some embodiments, the linker is cleaved under physiological conditions. In some embodiments, the linker is selected from ssRNA, ssDNA, dsRNA, dsDNA, peptide, S-S-linkers and pH sensitive linkers. In some embodiments, the linker moiety is attached to the 3' end of the sense strand of the nucleic acid. In some embodiments, the shielding compound comprises a pH-sensitive linker or a pH-sensitive moiety. In some embodiments, the pH-sensitive linker or pH-sensitive moiety is an anionic linker or an anionic moiety. In some embodiments, the anionic linker or anionic moiety is less anionic or neutral in an acidic environment. In some embodiments, the pH-sensitive linker or the pH-sensitive moiety is selected from the oligo (glutamic acid), oligophenolate(s) and diethylene triamine penta acetic acid.

In any of the LNP embodiments in the previous paragraph, the LNP can have an osmolality between about 50 to 600 mosmole/kg, between about 250 to 350 mosmole/kg, or between about 280 to 320 mosmole/kg, and/or wherein the LNP formed by the lipid and/or one or two helper lipids and the shielding compound have a particle size between about 20 to 200 nm, between about 30 to 100 nm, or between about 40 to 80 nm.

In some embodiments, the shielding compound provides for a longer circulation time in vivo and allows for a better biodistribution of the nucleic acid containing LNP. In some embodiments, the shielding compound prevents immediate interaction of the LNP with serum compounds or compounds of other bodily fluids or cytoplasma membranes, e.g., cytoplasma membranes of the endothelial lining of the vasculature, into which the LNP is administered. Additionally or alternatively, in some embodiments, the shielding compounds also prevent elements of the immune system from immediately interacting with the LNP. Additionally or alternatively, in some embodiments, the shielding compound acts as an anti-opsonizing compound. Without wishing to be bound by any mechanism or theory, in some embodiments, the shielding compound forms a cover or coat that reduces the surface area of the LNP available for interaction with its environment. Additionally or alternatively, in some embodiments, the shielding compound shields the overall charge of the LNP.

In another embodiment, the LNP includes at least one cationic lipid having Formula VI:

(Formula VI)

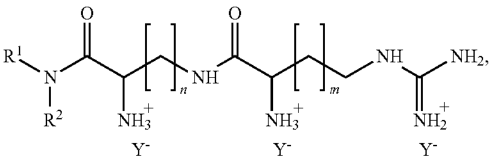

wherein n is 1, 2, 3, or 4, wherein m is 1, 2, or 3, wherein $Y^-$ is anion, wherein each of $R^1$ and R2 is individually and independently selected from the group consisting of linear C12-C18 alkyl and linear C12-C18 alkenyl, a sterol compound, wherein the sterol compound is selected from the group consisting of cholesterol and stigmasterol, and a PEGylated lipid, wherein the PEGylated lipid comprises a PEG moiety, wherein the PEGylated lipid is selected from the group consisting of:

a PEGylated phosphoethanolamine of Formula VII:

(Formula VII)

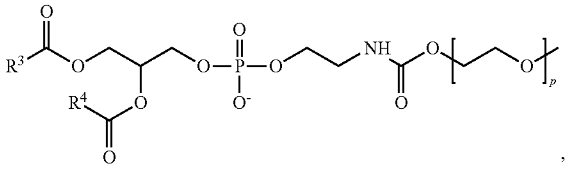

, wherein $R^3$ and $R^4$ are individually and independently linear C13-C17 alkyl, and p is any integer between 15 to 130;

a PEGylated ceramide of Formula VIII:

(Formula VIII)

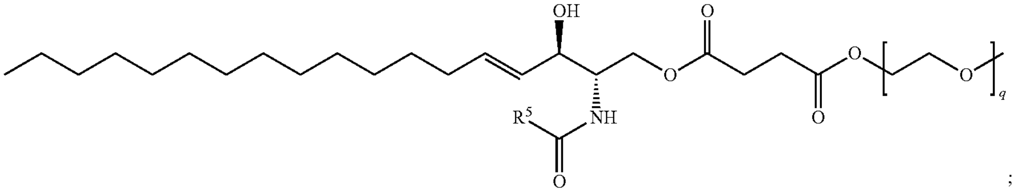

;

wherein $R^5$ is linear C7-C15 alkyl, and q is any number between 15 to 130; and a PEGylated diacylglycerol of Formula IX:

(Formula IX)

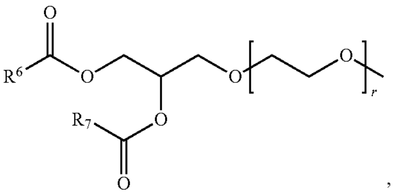

, wherein each of $R^6$ and $R^7$ is individually and independently linear C11-C17 alkyl, and r is any integer from 15 to 130.

In some embodiments, $R^1$ and $R^2$ are different from each other. In some embodiments, $R^1$ is palmityl and $R^2$ is oleyl. In some embodiments, $R^1$ is lauryl and $R^2$ is myristyl. In some embodiments, $R^1$ and $R^2$ are the same. In some embodiments, each of $R^1$ and $R^2$ is individually and independently selected from the group consisting of C12 alkyl, C14 alkyl, C16 alkyl, C18 alkyl, C12 alkenyl, C14 alkenyl, C16 alkenyl and C18 alkenyl. In some embodiments, each of C12 alkenyl, C14 alkenyl, C16 alkenyl and C18 alkenyl comprises one or two double bonds. In some embodiments, C18 alkenyl is C18 alkenyl with one double bond between C9 and C10. In some embodiments, C18 alkenyl is cis-9-octadecyl.

In some embodiments, the cationic lipid is a compound of Formula X:

(Formula X)

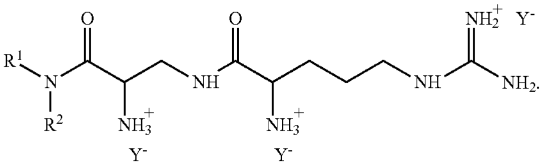

In some embodiments, $Y^-$ is selected from halogenids, acetate and trifluoroacetate. In some embodiments, the cationic lipid is β-arginyl-2,3-diamino propionic acid-N-palmityl-N-oleyl-amide trihydrochloride of Formula III:

(Formula III)

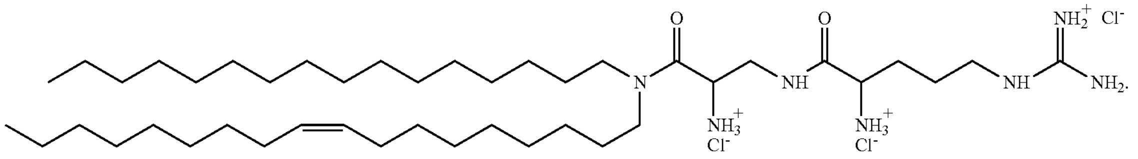

In some embodiments, the cationic lipid is β-arginyl-2,3-diamino propionic acid-N-lauryl-N-myristyl-amide trihydrochloride of Formula IV:

(Formula IV)

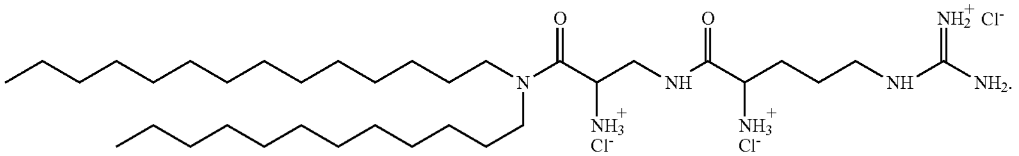

In some embodiments, the cationic lipid is β-arginyl-lysine-N-lauryl-N-myristyl-amide trihydrochloride of Formula V:

(Formula V)

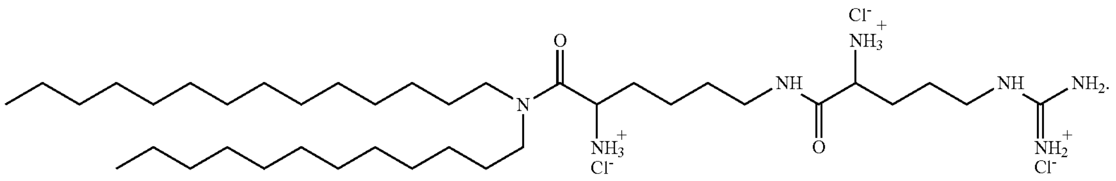

In some embodiments, the sterol compound is cholesterol. In some embodiments, the sterol compound is stigmasterin.

In some embodiments, the PEG moiety of the PEGylated lipid has a molecular weight from about 800 to 5,000 Da. In some embodiments, the molecular weight of the PEG moiety of the PEGylated lipid is about 800 Da. In some embodiments, the molecular weight of the PEG moiety of the PEGylated lipid is about 2,000 Da. In some embodiments, the molecular weight of the PEG moiety of the PEGylated lipid is about 5,000 Da. In some embodiments, the PEGylated lipid is a PEGylated phosphoethanolamine of Formula VII, wherein each of $R^3$ and $R^4$ is individually and independently linear C13-C17 alkyl, and p is any integer from 18, 19 or 20, or from 44, 45 or 46 or from 113, 114 or 115. In some embodiments, $R^3$ and $R^4$ are the same. In some embodiments, $R^3$ and $R^4$ are different. In some embodiments, each of $R^3$ and $R^4$ is individually and independently selected from the group consisting of C13 alkyl, C15 alkyl and C17 alkyl. In some embodiments, the PEGylated phosphoethanolamine of Formula VII is 1,2-distearoyl-sn-glycero-3-phosphoethanolamine-N-[methoxy(polyethylene glycol)-2000] (ammonium salt):

(Formula XI)

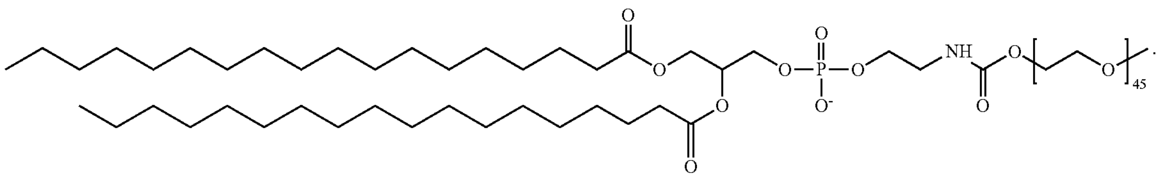

In some embodiments, the PEGylated phosphoethanolamine of Formula VII is 1,2-distearoyl-sn-glycero-3-phosphoethanolamine-N-[methoxy(polyethylene glycol)-5000] (ammonium salt):

(Formula XII)

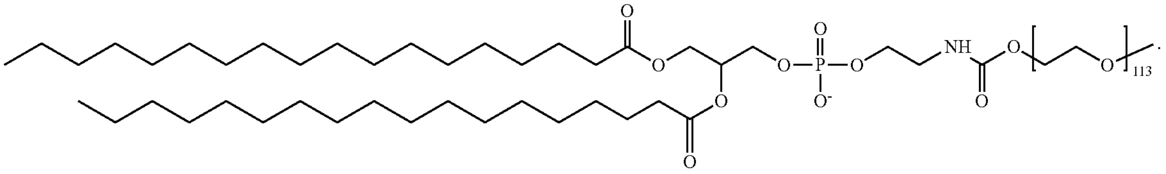

In some embodiments, the PEGylated lipid is a PEGylated ceramide of Formula VIII, wherein $R^5$ is linear C7-C15 alkyl, and q is any integer from 18, 19 or 20, or from 44, 45 or 46 or from 113, 114 or 115. In some embodiments, $R^5$ is linear C7 alkyl. In some embodiments, $R^5$ is linear C15 alkyl. In some embodiments, the PEGylated ceramide of Formula VIII is N-octanoyl-sphingosine-1-{succinyl [methoxy(polyethylene glycol) 2000]}:

(Formula XIII)

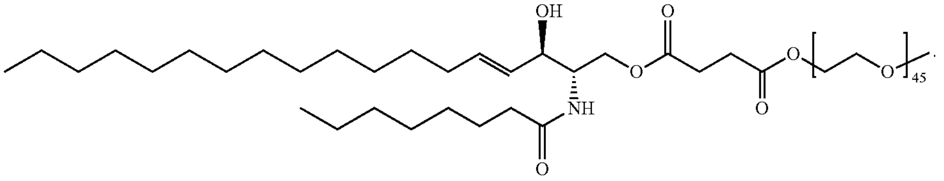

In some embodiments, the PEGylated ceramide of Formula VIII is N-palmitoyl-sphingosine-1-{succinyl[methoxy (polyethylene glycol) 2000]}

(Formula XIV)

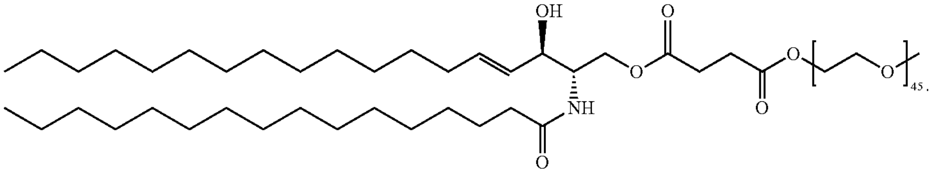

In some embodiments, the PEGylated lipid is a PEGylated diacylglycerol of Formula IX, wherein each of $R^6$ and $R^7$ is individually and independently linear C11-C17 alkyl, and r is any integer from 18, 19 or 20, or from 44, 45 or 46 or from 113, 114 or 115. In some embodiments, $R^6$ and $R^7$ are the same. In some embodiments, $R^6$ and $R^7$ are different. In some embodiments, each of $R^6$ and $R^7$ is individually and independently selected from the group consisting of linear C17 alkyl, linear C15 alkyl and linear C13 alkyl. In some embodiments, the PEGylated diacylglycerol of Formula IX 1,2-Distearoyl-sn-glycerol[methoxy(polyethylene glycol) 2000]:

(Formula XV)

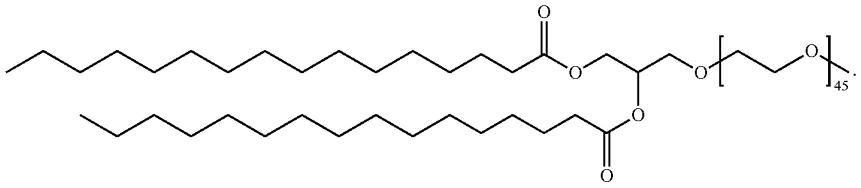

In some embodiments, the PEGylated diacylglycerol of Formula IX is 1,2-Dipalmitoyl-sn-glycerol[methoxy(polyethylene glycol) 2000]:

(Formula XVI)

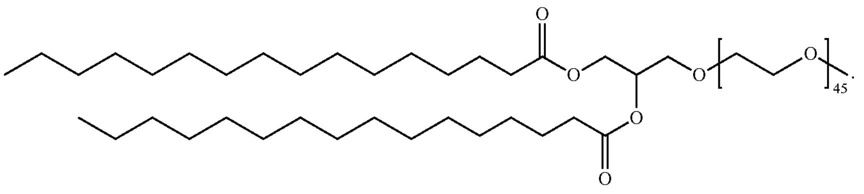

In some embodiments, the PEGylated diacylglycerol of Formula IX is:

(Formula XVII)

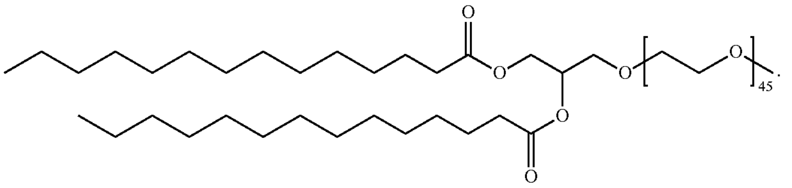

In some embodiments, the LNP includes at least one cationic lipid selected from of Formulas III, IV, and V, at least one sterol compound selected from a cholesterol and stigmasterin, and wherein the PEGylated lipid is at least one selected from Formulas XI and XII. In some embodiments, the LNP includes at least one cationic lipid selected from Formulas III, IV, and V, at least one sterol compound selected from a cholesterol and stigmasterin, and wherein the PEGylated lipid is at least one selected from Formulas XIII and XIV. In some embodiments, the LNP includes at least one cationic lipid selected from Formulas III, IV, and V, at least one sterol compound selected from a cholesterol and stigmasterin, and wherein the PEGylated lipid is at least one selected from Formulas XV and XVI. In some embodiments, the LNP includes a cationic lipid of Formula III, a cholesterol as the sterol compound, and wherein the PEGylated lipid is Formula XI.

In any of the LNP embodiments in the previous paragraph, wherein the content of the cationic lipid composition is between about 65 mole % to 75 mole %, the content of the sterol compound is between about 24 mole % to 34 mole % and the content of the PEGylated lipid is between about 0.5 mole % to 1.5 mole %, wherein the sum of the content of the cationic lipid, of the sterol compound and of the PEGylated lipid for the lipid composition is 100 mole %. In some embodiments, the cationic lipid is about 70 mole %, the content of the sterol compound is about 29 mole % and the content of the PEGylated lipid is about 1 mole %. In some embodiments, the LNP is 70 mole % of Formula III, 29 mole % of cholesterol, and 1 mole % of Formula XI.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29:341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by nanoparticle tracking analysis (NTA) and electron microscopy. Alvarez-Erviti et al. obtained 6-12 μg of exosomes (measured based on protein concentration) per $10^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 μF resulted in the greatest retention of RNA and was used for all subsequent experiments.

Alvarez-Erviti et al. administered 150 μg of each BACE1 siRNA encapsulated in 150 μg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, $P<0.05$, versus 62%, $P<0.01$) in both siRNA-RVG-9R-treated and siRNARVG exosome-treated mice was observed, resulting from a significant decrease in BACE1 mRNA levels (66% [+ or −] 15%, $P<0.001$ and 61% [+ or −] 13% respectively, $P<0.01$). Moreover, Applicants demonstrated a significant decrease (55%, $P<0.05$) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the CD-functionalized CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi: 10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi: 10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi: 10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi: 10.1155/2011/469679 for review).

In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Trojan Horse Liposomes may be used to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the CD-functionalized CRISPR Cas system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000) carbamoyl]-1,2-dimyrestyloxypropylamine, and cationic 1,2-dilinoleyloxy-3-N,Ndimethylaminopropane (see, e.g., Geisbert et al., Lancet 2010; 375:1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-CDMA, and 1,2-dilinoleyloxy-3-(N,N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC)—both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Biotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 μm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the CD-functionalized CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol) 2000) propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11+0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume: 29, Pages: 154-157 (2011)) describes the use of lipid envelopes to deliver RNA. Use of lipid envelopes is also preferred in the present invention.

In another embodiment, lipids may be formulated with the CD-functionalized CRISPR Cas system of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with CRISPR Cas instead of siRNA (see, e.g., Novobrantseva, Molecular Therapy-Nucleic Acids (2012) 1, e4; doi: 10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid: siRNA weight ratio may be ~12:1 and 9:1 in the case of DLin-KC2-DMA and C12-200 lipid nanoparticles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The CD-functionalized CRISPR Cas system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid: fusogenic lipid:cholesterol: PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application No. 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2): 1016-26; Uchegbu and Siew, 2013, J Pharm Sci. 102(2): 305-10 and Lalatsa et al., 2012, J Control Release. 2012 Jul. 20; 161(2): 523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesised from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—$P(O_2)$ S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application No. 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of CD-functionalized CRISPR Cas system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of CD-functionalized CRISPR Cas system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. The creation and characterization of supercharged proteins has been reported in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116) (However, pilot experiments varying the dose of protein and RNA should be performed to optimize the procedure for specific cell lines): (1) One day before treatment, plate $1\times10^5$ cells per well in a 48-well plate. (2) On the day of treatment, dilute purified +36 GFP protein in serumfree media to a final concentration 200 nM. Add RNA to a final concentration of 50 nM. Vortex to mix and incubate at room temperature for 10 min. (3) During incubation, aspirate media from cells and wash once with PBS. (4) Following incubation of +36 GFP and RNA, add the protein-RNA complexes to cells. (5) Incubate cells with complexes at 37° C. for 4 h. (6) Following incubation, aspirate the media and wash three times with 20 U/mL heparin PBS. Incubate cells with serum-containing media for a further 48 h or longer depending upon the assay for activity. (7) Analyze cells by immunoblot, qPCR, phenotypic assay, or other appropriate method.

It has been further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications: (1) One day before treatment, plate $1\times10^5$ per well in a 48-well plate. (2) On the day of treatment, dilute purified b36 GFP protein in serumfree media to a final concentration 2 mM. Add 1 mg of plasmid DNA. Vortex to mix and incubate at room temperature for 10 min. (3) During incubation, aspirate media from cells and wash once with PBS. (4) Following incubation of b36 GFP and plasmid DNA, gently add the protein-DNA complexes to cells. (5) Incubate cells with complexes at 37° C. for 4 h. (6) Following incubation, aspirate the media and wash with PBS. Incubate cells in serum-containing media and incubate for a further 24-48 h. (7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19(7), 831-843 (2012). The methods of the super charged proteins may be used and/or adapted for delivery of the CD-functionalized CRISPR Cas system of the present invention. These systems in conjunction with herein teaching can be employed in the delivery of CD-functionalized CRISPR Cas system(s) or component(s) thereof or nucleic acid molecule(s) coding therefor Cell Penetrating Peptides (CPPs)

In yet another embodiment, cell penetrating peptides (CPPs) are contemplated for the delivery of the CD-functionalized CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles, including nanoparticles, liposomes, chromophores, small molecules and radioactive materials. In aspects of the invention, the cargo may also comprise any component of the CD-functionalized CRISPR Cas system or the entire CD-functionalized functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. No. 8,575,305; 8,614,194 and 8,044,019. CPPs can be used to deliver the CD-functionalized CRISPR-Cas system or components thereof. That CPPs can be employed to deliver the CD-functionalized CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2, incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Aerosol Delivery

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector.

Packaging and Promoters

The promoter used to drive CRISPR-Cas protein and cytidine deaminase coding nucleic acid molecule expression can include AAV ITR, which can serve as a promoter. This is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of Cas13.

For ubiquitous expression, promoters that can be used include: CMV, CAG, CBh, PGK, SV40, Ferritin heavy or light chains, etc. For brain or other CNS expression, SynapsinI can be used for all neurons, CaMKIIalpha can be used for excitatory neurons, GAD67 or GAD65 or VGAT can be used for GABAergic neurons. For liver expression, Albumin promoter can be used. For lung expression, SP—B can be used. For endothelial cells, ICAM can be used. For hematopoietic cells, IFNbeta or CD45 can be used. For Osteoblasts, the OG-2 can be used.

The promoter used to drive guide RNA can include Pol III promoters such as U6 or H1, as well as use of Pol II promoter and intronic cassettes to express guide RNA.

Adeno Associated Virus (AAV)

The CRISPR-Cas protein, cytidine deaminase, and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of Cas13 and cytidine deaminase can be driven by a cell-type specific promoter. For example, liver-specific expression might use the Albumin promoter and neuron-specific expression (e.g., for targeting CNS disorders) might use the Synapsin I promoter.

In terms of in vivo delivery, AAV is advantageous over other viral vectors for a couple of reasons: low toxicity (this may be due to the purification method not requiring ultra centrifugation of cell particles that can activate the immune response); and low probability of causing insertional mutagenesis because it doesn't integrate into the host genome.

AAV has a packaging limit of 4.5 or 4.75 Kb. This means that Cas13 as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore, embodiments of the invention include utilizing homologs of Cas13 that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82:5887-5911 (2008)) is as follows:

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentiviruses

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 ug of psPAX2 (gag/pol/rev/tat). Transfection was done in 4 mL OptiMEM with a cationic lipid delivery agent (50 μL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 μm low protein binding (PVDF) filter. They were then spun in a ultracentrifuge for 2 hours at 24,000 rpm. Viral pellets were resuspended in 50 ul of DMEM overnight at 4° C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8:275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the CD-functionalized CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CD-functionalized CRISPR-Cas system of the present invention. A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

Lentiviral vectors have been disclosed as in the treatment for Parkinson's Disease, see, e.g., US Patent Publication No.

20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and US Patent No. U.S. Pat. No. 7,259,015.

Application in Non-Animal Organisms

The CD-functionalized CRISPR system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The CD-functionalized CRISPR system can be used with regard to plants in Site-Directed Integration (SDI) or Gene Editing (GE) or any Near Reverse Breeding (NRB) or Reverse Breeding (RB) techniques. Aspects of utilizing the herein described Cas13 effector protein system may be analogous to the use of the CRISPR-Cas (e.g., CRISPR-Cas9) system in plants, and mention is made of the University of Arizona website "CRISPR-PLANT" (www.genome.arizona.edu/crispr/) (supported by Penn State and AGI). Emodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi: 10.1186/1746-4811-9-39); Brooks, "Efficient gene editing in tomato in the first generation using the CRISPR-Cas9 system," Plant Physiology September 2014 pp 114247577; Shan, "Targeted genome modification of crop plants using a CRISPR-Cas system," Nature Biotechnology 31, 686-688 (2013); Feng, "Efficient genome editing in plants using a CRISPR-Cas system," Cell Research (2013) 23:1229-1232. doi: 10.1038/cr.2013.114; published online 20 Aug. 2013; Xie, "RNA-guided genome editing in plants using a CRISPR-Cas system," Mol Plant. 2013 November; 6(6): 1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061—Agrobacterium-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13(2): 85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein.

Application of CD-Functionalized CRISPR System to Plants and Yeast

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for genome editing using the CD-functionalized CRISPR system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and systems can be used over a broad range of plants, such as for example with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g those belonging to the orders Pinales, Ginkgoales, Cycadales, Araucariales, Cupressales and Gnetales.

The CD-functionalized CRISPR systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*; and the genera *Allium, Andropogon, Aragrostis, Asparagus, Avena, Cynodon, Elaeis, Festuca, Festulolium, Heterocallis, Hordeum, Lemna, Lolium, Mus*a, *Oryza, Panicum, Pannesetum, Phleum, Poa, Secale, Sorghum, Triticum, Zea, Abies, Cunninghamia, Ephedra, Picea, Pinus*, and *Pseudotsuga.*

The CD-functionalized CRISPR systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira*, and *Trichodesmium.*

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendents of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerervisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces*

*lactis* and *Kluyveromyces marxianus*), *Neurospora* spp. (e.g., *Neurospora crassa*), *Fusarium* spp. (e.g., *Fusarium oxysporum*), and Issatchenkia spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploid cells than in haploid cells, and thus the methods using the CD-functionalized CRISPR system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, $2^{nd}$ edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2μ plasmids, yeast integrative plasmids, yeast replicative plasmids, shuttle vectors, and episomal plasmids.

Stable Integration of CD-Functionalized CRISPR System Components in the Genome of Plants and Plant Cells In particular embodiments, it is envisaged that the polynucleotides encoding the components of the CD-functionalized CRISPR system are introduced for stable integration into the genome of a plant cell. In these embodiments, the design of the transformation vector or the expression system can be adjusted depending on for when, where and under what conditions the guide RNA and/or fusion protein of cytidine deaminase and Cas13 are expressed.

In particular embodiments, it is envisaged to introduce the components of the CD-functionalized CRISPR system stably into the genomic DNA of a plant cell. Additionally or alternatively, it is envisaged to introduce the components of the CD-functionalized CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the RNA and/or fusion protein of cytidine deaminase and Cas13 in a plant cell; a 5' untranslated region to enhance expression; an intron element to further enhance expression in certain cells, such as monocot cells; a multiple-cloning site to provide convenient restriction sites for inserting the guide RNA and/or the fusion protein of cytidine deaminase and Cas13 encoding sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a CD-functionalized CRISPR expression system comprises at least: a nucleotide sequence encoding a guide RNA (gRNA) that hybridizes with a target sequence in a plant, and wherein the guide RNA comprises a guide sequence and a direct repeat sequence, and a nucleotide sequence encoding a fusion protein of cytidine deaminase and Cas13, wherein components (a) or (b) are located on the same or on different constructs, and whereby the different nucleotide sequences can be under control of the same or a different regulatory element operable in a plant cell.

DNA construct(s) containing the components of the CD-functionalized CRISPR system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1): 11-9). The basis of particle bombardment is the acceleration of particles coated with gene/s of interest toward cells, resulting in the penetration of the protoplasm by the particles and typically stable integration into the genome. (see, e.g. Klein et al, Nature (1987), Klein et ah, Bio/Technology (1992), Casas et ah, Proc. Natl. Acad. Sci. USA (1993).).

In particular embodiments, the DNA constructs containing components of the CD-functionalized CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the CD-functionalized CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the CD-functionalized CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the CD-functionalized CRISPR system are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Inducible promoters can be of interest to express one or more of the components of the CD-functionalized CRISPR system under limited circumstances to avoid non-specific activity of the deaminase. In particular embodiments, one or more elements of the CD-functionalized CRISPR system are expressed under control of an inducible promoter. Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome)., such as a Light Inducible Transcriptional Effector (LITE) that direct changes in transcriptional activity in a sequence-specific manner. The components of a light inducible system may include a fusion protein of cytidine deaminase and Cas13, a light-responsive cytochrome heterodimer (e.g. from *Arabidopsis thaliana*). Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the CD-functionalized CRISPR system is used to specifically modify chloroplast genes or to ensure expression in the chloroplast. For this purpose use is made of chloroplast transformation methods or compartimentalization of the CD-functionalized CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the pastid can be used as described in WO2010061186.

Alternatively, it is envisaged to target one or more of the CD-functionalized CRISPR components to the plant chloroplast. This is achieved by incorporating in the expression construct a sequence encoding a chloroplast transit peptide (CTP) or plastid transit peptide, operably linked to the 5' region of the sequence encoding the fusion protein of cytidine deaminase and Cas13. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol.

61:157-180). In such embodiments it is also desired to target the guide RNA to the plant chloroplast. Methods and constructs which can be used for translocating guide RNA into the chloroplast by means of a chloroplast localization sequence are described, for instance, in US20040142476, incorporated herein by reference. Such variations of constructs can be incorporated into the expression systems of the invention to efficiently translocate the CD-functionalized CRISPR system components.

Introduction of Polynucleotides Encoding the CD-Functionalized CRISPR System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the CD-functionalized CRISPR system described herein can be applied on *Chlamydomonas* species and other algae. In particular embodiments, a CRISPR-Cas protein (e.g., Cas13), cytidine deaminase (which may be fused to the CRISPR-Cas protein or an aptamer-binding adaptor protein), and guide RNA are introduced in algae expressed using a vector that expresses the fusion protein of cytidine deaminase and Cas13 under the control of a constitutive promoter such as Hsp70A-Rbc S2 or Beta2-tubulin. Guide RNA is optionally delivered using a vector containing T7 promoter. Alternatively, Cas13 mRNA and in vitro transcribed guide RNA can be delivered to algal cells. Electroporation protocols are available to the skilled person such as the standard recommended protocol from the GeneArt *Chlamydomonas* Engineering kit.

Introduction of CD-Functionalized CRISPR System Components in Yeast Cells

In particular embodiments, the invention relates to the use of the CD-functionalized CRISPR system for genome editing of yeast cells. Methods for transforming yeast cells which can be used to introduce polynucleotides encoding the CD-functionalized CRISPR system components are described in Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of CD-Functionalized CRISPR System Components in Plants and Plant Cell In particular embodiments, it is envisaged that the guide RNA and/or CRISPR-Cas gene are transiently expressed in the plant cell. In these embodiments, the CD-functionalized CRISPR system can ensure modification of a target gene only when both the guide RNA, the CRISPR-Cas protein (e.g., Cas13), and cytidine deaminase (which may be fused to the CRISPR-Cas protein or an aptamer-binding adaptor protein), are present in a cell, such that genomic modification can further be controlled. As the expression of the CRISPR-Cas protein is transient, plants regenerated from such plant cells typically contain no foreign DNA. In particular embodiments the CRISPR-Cas protein is stably expressed by the plant cell and the guide sequence is transiently expressed.

In particular embodiments, the CD-functionalized CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

In particular embodiments, the vector used for transient expression of CD-functionalized CRISPR system is for instance a pEAQ vector, which is tailored for *Agrobacterium*-mediated transient expression (Sainsbury F. et al., Plant Biotechnol J. 2009 September; 7(7): 682-93) in the protoplast. Precise targeting of genomic locations was demonstrated using a modified Cabbage Leaf Curl virus (CaLCuV) vector to express guide RNAs in stable transgenic plants expressing a CRISPR enzyme (Scientific Reports 5, Article number: 14926 (2015), doi: 10.1038/srep14926).

In particular embodiments, double-stranded DNA fragments encoding the guide RNA and/or the CRISPR-Cas gene can be transiently introduced into the plant cell. In such embodiments, the introduced double-stranded DNA fragments are provided in sufficient quantity to modify the cell but do not persist after a contemplated period of time has passed or after one or more cell divisions. Methods for direct DNA transfer in plants are known by the skilled artisan (see for instance Davey et al. Plant Mol Biol. 1989 September; 13(3): 273-85.)

In other embodiments, an RNA polynucleotide encoding the CRISPR-Cas protein (e.g., Cas13) and/or cytidine deaminase (which may be fused to the CRISPR-Cas protein or an aptamer-binding adaptor protein) is introduced into the plant cell, which is then translated and processed by the host cell generating the protein in sufficient quantity to modify the cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122).

Combinations of the different methods described above are also envisaged.

Delivery of CD-Functionalized CRISPR System Components to the Plant Cell

In particular embodiments, it is of interest to deliver one or more components of the CD-functionalized CRISPR system directly to the plant cell. This is of interest, inter alia, for the generation of non-transgenic plants (see below). In particular embodiments, one or more of the CD-functionalized CRISPR system components is prepared outside the plant or plant cell and delivered to the cell. For instance in particular embodiments, the CRISPR-Cas protein is prepared in vitro prior to introduction to the plant cell. The CRISPR-Cas protein can be prepared by various methods known by one of skill in the art and include recombinant production. After expression, the CRISPR-Cas protein is isolated, refolded if needed, purified and optionally treated to remove any purification tags, such as a His-tag. Once crude, partially purified, or more completely purified CRISPR-Cas protein is obtained, the protein may be introduced to the plant cell.

In particular embodiments, the CRISPR-Cas protein is mixed with guide RNA targeting the gene of interest to form a pre-assembled ribonucleoprotein.

The individual components or pre-assembled ribonucleoprotein can be introduced into the plant cell via electroporation, by bombardment with CRISPR-Cas-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology,* 2015; DOI: 10.1038/nbt.3389).

In particular embodiments, the CD-functionalized CRISPR system components are introduced into the plant cells using nanoparticles. The components, either as protein or nucleic acid or in a combination thereof, can be uploaded onto or packaged in nanoparticles and applied to the plants (such as for instance described in WO 2008042156 and US20130185823). In particular, embodiments of the invention comprise nanoparticles uploaded with or packed with DNA molecule(s) encoding the CRISPR-Cas protein (e.g., Cas13), DNA molecule(s) encoding cytidine deaminase (which may be fused to the CRISPR-Cas protein or an aptamer-binding adaptor protein), and DNA molecules encoding the guide RNA and/or isolated guide RNA as described in WO2015089419.

Further means of introducing one or more components of the CD-functionalized CRISPR system to the plant cell is by using cell penetrating peptides (CPP). Accordingly, in particular, embodiments the invention comprises compositions comprising a cell penetrating peptide linked to the CRISPR-Cas protein. In particular embodiments of the present invention, the CRISPR-Cas protein and/or guide RNA is coupled to one or more CPPs to effectively transport them inside plant protoplasts. Ramakrishna (Genome Res. 2014 June; 24(6): 1020-7 for Cas9 in human cells). In other embodiments, the CRISPR-Cas gene and/or guide RNA are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipatic peptides, peptides having proline-rich and anti-microbial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biolomolecule with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence; polyarginine peptide Args sequence, Guanine rich-molecular transporters, sweet arrow peptide, etc.

Use of the CD-Functionalized CRISPR System to Make Genetically Modified Non-Transgenic Plants In particular embodiments, the methods described herein are used to modify endogenous genes or to modify their expression without the permanent introduction into the genome of the plant of any foreign gene, including those encoding CRISPR components, so as to avoid the presence of foreign DNA in the genome of the plant. This can be of interest as the regulatory requirements for non-transgenic plants are less rigorous.

In particular embodiments, this is ensured by transient expression of the CD-functionalized CRISPR system components. In particular embodiments one or more of the components are expressed on one or more viral vectors which produce sufficient CRISPR-Cas protein, cytidine deaminase, and guide RNA to consistently steadily ensure modification of a gene of interest according to a method described herein.

In particular embodiments, transient expression of CD-functionalized CRISPR system constructs is ensured in plant protoplasts and thus not integrated into the genome. The limited window of expression can be sufficient to allow the CD-functionalized CRISPR system to ensure modification of a target gene as described herein.

In particular embodiments, the different components of the CD-functionalized CRISPR system are introduced in the plant cell, protoplast or plant tissue either separately or in mixture, with the aid of pariculate delivering molecules such as nanoparticles or CPP molecules as described herein above.

The expression of the CD-functionalized CRISPR system components can induce targeted modification of the genome, by deaminase activity of the cytidine deaminase. The different strategies described herein above allow CRISPR-mediated targeted genome editing without requiring the introduction of the CD-functionalized CRISPR systemt components into the plant genome. Components which are transiently introduced into the plant cell are typically removed upon crossing.

Plant Cultures and Regeneration

In particular embodiments, plant cells which have a modified genome and that are produced or obtained by any of the methods described herein, can be cultured to regenerate a whole plant which possesses the transformed or modified genotype and thus the desired phenotype. Conventional regeneration techniques are well known to those skilled in the art. Particular examples of such regeneration techniques rely on manipulation of certain phytohormones in a tissue culture growth medium, and typically relying on a biocide and/or herbicide marker which has been introduced together with the desired nucleotide sequences. In further particular embodiments, plant regeneration is obtained from cultured protoplasts, plant callus, explants, organs, pollens, embryos or parts thereof (see e.g. Evans et al. (1983), Handbook of Plant Cell Culture, Klee et al (1987) Ann. Rev. of Plant Phys.)

In particular embodiments, transformed or improved plants as described herein can be self-pollinated to provide seed for homozygous improved plants of the invention (homozygous for the DNA modification) or crossed with non-transgenic plants or different improved plants to provide seed for heterozygous plants. Where a recombinant DNA was introduced into the plant cell, the resulting plant of such a crossing is a plant which is heterozygous for the recombinant DNA molecule. Both such homozygous and heterozygous plants obtained by crossing from the improved plants and comprising the genetic modification (which can be a recombinant DNA) are referred to herein as "progeny". Progeny plants are plants descended from the original transgenic plant and containing the genome modification or recombinant DNA molecule introduced by the methods provided herein. Alternatively, genetically modified plants can be obtained by one of the methods described supra using the CD-functionalized CRISPR system whereby no foreign DNA is incorporated into the genome. Progeny of such plants, obtained by further breeding may also contain the genetic modification. Breedings are performed by any breeding methods that are commonly used for different crops (e.g., Allard, Principles of Plant Breeding, John Wiley & Sons, NY, U. of CA, Davis, CA, 50-98 (1960).

Generation of Plants with Enhanced Agronomic Traits

The CD-functionalized CRISPR systems provided herein can be used to introduce targeted A-G and T(U)-C mutations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

In particular embodiments, the CD-functionalized CRISPR system as described herein is used to introduce targeted A-G and T(U)-C mutations. Such mutation can be a nonsense mutation (e.g., premature stop codon) or a missense mutation (e.g., encoding different amino acid residue). This is of interest where the A-G and T(U)-C mutations in certain endogenous genes can confer or contribute to a desired trait.

The methods described herein generally result in the generation of "improved plants" in that they have one or more desirable traits compared to the wildtype plant. In particular embodiments, the plants, plant cells or plant parts obtained are transgenic plants, comprising an exogenous DNA sequence incorporated into the genome of all or part of the cells of the plant. In particular embodiments, non-transgenic genetically modified plants, plant parts or cells are obtained, in that no exogenous DNA sequence is incorporated into the genome of any of the plant cells of the plant. In such embodiments, the improved plants are non-transgenic. Where only the modification of an endogenous gene is ensured and no foreign genes are introduced or maintained in the plant genome, the resulting genetically modified crops contain no foreign genes and can thus basically be considered non-transgenic.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the CRISPR-Cas protein, the cytidine deaminase, and the guide RNA, where the delivering is via *Agrobacterium*. The polynucleotide sequence encoding the components of the CD-functionalized CRISPR system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage.

In particular embodiments of the methods described above, disease resistant crops are obtained by targeted mutation of disease susceptibility genes or genes encoding negative regulators (e.g. Mlo gene) of plant defense genes. In a particular embodiment, herbicide-tolerant crops are generated by targeted substitution of specific nucleotides in plant genes such as those encoding acetolactate synthase (ALS) and protoporphyrinogen oxidase (PPO). In particular embodiments drought and salt tolerant crops by targeted mutation of genes encoding negative regulators of abiotic stress tolerance, low amylose grains by targeted mutation of Waxy gene, rice or other grains with reduced rancidity by targeted mutation of major lipase genes in aleurone layer, etc. In particular embodiments. A more extensive list of endogenous genes encoding a traits of interest are listed below.

Use of CD-Functionalized CRISPR System to Modify Polyploid Plants

Many plants are polyploid, which means they carry duplicate copies of their genomes—sometimes as many as six, as in wheat. The methods according to the present invention, which make use of the CD-functionalized CRISPR system can be "multiplexed" to affect all copies of a gene, or to target dozens of genes at once. For instance, in particular embodiments, the methods of the present invention are used to simultaneously ensure a loss of function mutation in different genes responsible for suppressing defences against a disease. In particular embodiments, the methods of the present invention are used to simultaneously suppress the expression of the TaMLO-A1, TaMLO-B1 and TaMLO-D1 nucleic acid sequence in a wheat plant cell and regenerating a wheat plant therefrom, in order to ensure that the wheat plant is resistant to powdery mildew (see also WO2015109752).

Examplary Genes Conferring Agronomic Traits

In particular embodiments, the invention encompasses methods which involve targeted A-G and T(U)-C mutations in endogenous genes and their regulatory elements, such as listed below:

1. Genes that Confer Resistance to Pests or Diseases

Plant disease resistance genes. A plant can be transformed with cloned resistance genes to engineer plants that are resistant to specific pathogen strains. See, e.g., Jones et al., Science 266:789 (1994) (cloning of the tomato Cf-9 gene for resistance to *Cladosporium fulvum*); Martin et al., Science 262:1432 (1993) (tomato Pto gene for resistance to *Pseudomonas syringae* pv. tomato encodes a protein kinase); Mindrinos et al., Cell 78:1089 (1994) (Arabidopsmay be RSP2 gene for resistance to *Pseudomonas syringae*). A plant gene that is upregulated or down regulated during pathogen infection can be engineered for pathogen resistance. See, e.g., Thomazella et al., bioRxiv 064824; doi: https://doi.org/10.1101/064824 Epub. Jul. 23, 2016 (tomato plants with deletions in the SIDMR6-1 which is normally upregulated during pathogen infection).

Genes conferring resistance to a pest, such as soybean cyst nematode. See e.g., PCT Application WO 96/30517; PCT Application WO 93/19181.

*Bacillus thuringiensis* proteins see, e.g., Geiser et al., Gene 48:109 (1986).

Lectins, see, for example, Van Damme et al., *Plant Molec. Biol.* 24:25 (1994.

Vitamin-binding protein, such as avidin, see PCT application US93/06487, teaching the use of avidin and avidin homologues as larvicides against insect pests.

Enzyme inhibitors such as protease or proteinase inhibitors or amylase inhibitors. See, e.g., Abe et al., J. Biol. Chem. 262:16793 (1987), Huub et al., *Plant Molec. Biol.* 21:985 (1993)), Sumitani et al., Biosci. Biotech. Biochem. 57:1243 (1993) and U.S. Pat. No. 5,494,813.

Insect-specific hormones or pheromones such as ecdysteroid or juvenile hormone, a variant thereof, a mimetic based thereon, or an antagonist or agonist thereof. See, for example Hammock et al., Nature 344:458 (1990).

Insect-specific peptides or neuropeptides which, upon expression, disrupts the physiology of the affected pest. For example Regan, J. Biol. Chem. 269:9 (1994) and Pratt et al., Biochem. Biophys. Res. Comm. 163:1243 (1989). See also U.S. Pat. No. 5,266,317.

Insect-specific venom produced in nature by a snake, a wasp, or any other organism. For example, see Pang et al., Gene 116:165 (1992).

Enzymes responsible for a hyperaccumulation of a monoterpene, a sesquiterpene, a steroid, hydroxamic acid, a phenylpropanoid derivative or another nonprotein molecule with insecticidal activity.

Enzymes involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See PCT application WO93/02197, Kramer et al., Insect Biochem. Molec. Biol. 23:691 (1993) and Kawalleck et al., *Plant Molec. Biol.* 21:673 (1993).

Molecules that stimulate signal transduction. For example, see Botella et al., Plant Molec. Biol. 24:757 (1994), and Griess et al., *Plant Physiol.* 104:1467 (1994).

Viral-invasive proteins or a complex toxin derived therefrom. See Beachy et al., Ann. rev. Phytopathol. 28:451 (1990).

Developmental-arrestive proteins produced in nature by a pathogen or a parasite. See Lamb et al., Bio/Technology 10:1436 (1992) and Toubart et al., *Plant J.* 2:367 (1992).

A developmental-arrestive protein produced in nature by a plant. For example, Logemann et al., Bio/Technology 10:305 (1992).

In plants, pathogens are often host-specific. For example, some *Fusarium* species will cause tomato wilt but attack only tomato, and other *Fusarium* species attack only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible or there can be partial resistance against all races of a pathogen, typically controlled by many genes and/or also complete resistance to some races of a pathogen but not to other races. Such resistance is typically controlled by a few genes. Using methods and components of the CD-functionalized CRISPR system, a new tool now exists to induce specific mutations in anticipation hereon. Accordingly, one can analyze the genome of sources of resistance genes, and in plants having desired characteristics or traits, use the method and components of the CD-functionalized CRISPR system to induce the rise of resistance genes. The present systems can do so with more precision than previous mutagenic agents and hence accelerate and improve plant breeding programs.

2. Genes Involved in Plant Diseases, Such as Those Listed in WO 2013046247

Rice diseases: *Magnaporthe grisea, Cochliobolus miyabeanus, Rhizoctonia solani, Gibberella fujikuroi*; Wheat diseases: *Erysiphe graminis, Fusarium graminearum, F. avenaceum, F. culmorum, Microdochium nivale, Puccinia striiformis, P. graminis, P. recondita, Micronectriella nivale, Typhula* sp., *Ustilago tritici, Tilletia caries, Pseudocercosporella herpotrichoides, Mycosphaerella graminicola, Stagonospora nodorum, Pyrenophora tritici*-repentis; Barley diseases: *Erysiphe graminis, Fusarium graminearum, F. avenaceum, F. culmorum, Microdochium nivale, Puccinia striiformis, P. graminis, P. hordei, Ustilago nuda, Rhynchosporium secalis, Pyrenophora teres, Cochliobolus sativus, Pyrenophora graminea, Rhizoctonia solani*; Maize diseases: *Ustilago maydis, Cochliobolus heterostrophus, Gloeocercospora sorghi, Puccinia polysora, Cercospora zeae-maydis, Rhizoctonia solani;*

Citrus diseases: *Diaporthe citri, Elsinoe fawcetti, Penicillium digitatum, P. italicum, Phytophthora parasitica, Phytophthora citrophthora*; Apple diseases: *Monilinia mali, Valsa ceratosperma, Podosphaera leucotricha, Alternaria alternata* apple pathotype, *Venturia inaequalis, Colletotrichum acutatum, Phytophtora cactorum;*

Pear diseases: *Venturia nashicola, V. pirina, Alternaria alternata* Japanese pear pathotype, *Gymnosporangium haraeanum, Phytophtora cactorum;*

Peach diseases: *Monilinia fructicola, Cladosporium carpophilum, Phomopsis* sp.;

Grape diseases: *Elsinoe ampelina, Glomerella cingulata, Uninula necator, Phakopsora ampelopsidis, Guignardia bidwellii, Plasmopara viticola;*

Persimmon diseases: *Gloesporium kaki, Cercospora kaki, Mycosphaerela nawae;*

Gourd diseases: *Colletotrichum lagenarium, Sphaerotheca fuliginea, Mycosphaerella melonis, Fusarium oxysporum, Pseudoperonospora cubensis, Phytophthora* sp., *Pythium* sp.;

Tomato diseases: *Alternaria solani, Cladosporium fulvum, Phytophthora infestans; Pseudomonas syringae* pv. Tomato; *Phytophthora capsici; Xanthomonas*

Eggplant diseases: *Phomopsis vexans, Erysiphe cichoracearum*; Brassicaceous vegetable diseases: *Alternaria japonica, Cercosporella brassicae, Plasmodiophora brassicae, Peronospora parasitica;*

Welsh onion diseases: *Puccinia allii, Peronospora* destructor;

Soybean diseases: *Cercospora kikuchii, Elsinoe glycines, Diaporthe phaseolorum* var. *sojae, Septoria glycines, Cercospora sojina, Phakopsora pachyrhizi, Phytophthora sojae, Rhizoctonia solani, Corynespora casiicola, Sclerotinia sclerotiorum;*

Kidney bean diseases: *Colletrichum lindemthianum;*

Peanut diseases: *Cercospora personata, Cercospora arachidicola, Sclerotium rolfsii;*

Pea diseases pea: *Erysiphe pisi;*

Potato diseases: *Alternaria solani, Phytophthora infestans, Phytophthora erythroseptica, Spongospora subterranean*, f. sp. *Subterranean;*

Strawberry diseases: *Sphaerotheca humuli, Glomerella cingulata;*

Tea diseases: *Exobasidium reticulatum, Elsinoe leucospila, Pestalotiopsis* sp., *Colletotrichum theae-sinensis;*

Tobacco diseases: *Alternaria longipes, Erysiphe cichoracearum, Colletotrichum tabacum, Peronospora tabacina, Phytophthora nicotianae;*

Rapeseed diseases: *Sclerotinia sclerotiorum, Rhizoctonia solani;*

Cotton diseases: *Rhizoctonia solani;*

Beet diseases: *Cercospora beticola, Thanatephorus cucumeris, Thanatephorus cucumeris, Aphanomyces cochlioides;*

Rose diseases: *Diplocarpon rosae, Sphaerotheca pannosa, Peronospora sparsa;*

Diseases of *chrysanthemum* and *asteraceae: Bremia lactuca, Septoria chrysanthemi-indici, Puccinia horiana;*

Diseases of various plants: *Pythium aphanidermatum, Pythium debarianum, Pythium graminicola, Pythium irregulare, Pythium ultimum, Botrytis cinerea, Sclerotinia sclerotiorum;*

Radish diseases: *Alternaria brassicicola;*

*Zoysia* diseases: *Sclerotinia homeocarpa, Rhizoctonia solani;*

Banana diseases: *Mycosphaerella fijiensis, Mycosphaerella musicola;*

Sunflower diseases: *Plasmopara halstedii;*

Seed diseases or diseases in the initial stage of growth of various plants caused by *Aspergillus* spp., *Penicillium* spp., *Fusarium* spp., *Gibberella* spp., *Tricoderma* spp., *Thielaviopsis* spp., *Rhizopus* spp., *Mucor* spp., *Corticium* spp., *Rhoma* spp., *Rhizoctonia* spp., *Diplodia* spp., or the like;

Virus diseases of various plants mediated by Polymixa spp., Olpidium spp., or the like.

3. Examples of Genes that Confer Resistance to Herbicides

Resistance to herbicides that inhibit the growing point or meristem, such as an imidazolinone or a sulfonylurea, for example, by Lee et al., EMBO J. 7:1241 (1988), and Miki et al., Theor. Appl. Genet. 80:449 (1990), respectively.

Glyphosate tolerance (resistance conferred by, e.g., mutant 5-enolpyruvylshikimate-3-phosphate synthase (EPSPs) genes, aroA genes and glyphosate acetyl transferase (GAT) genes, respectively), or resistance to other phosphono compounds such as by glufosinate (phosphinothricin acetyl transferase (PAT) genes from *Streptomyces* species, including *Streptomyces hygroscopicus* and *Streptomyces viridichromogenes*), and to pyridinoxy or phenoxy proprionic acids and cyclohexones by ACCase inhibitor-encoding genes. See, for example, U.S. Pat. Nos. 4,940,835 and 6,248,876, 4,769,061, EP No. 0 333 033 and U.S. Pat. No. 4,975,374. See also EP No. 0242246, DeGree F. et al., Bio/Technology 7:61 (1989), Marshall et al., Theor. Appl. Genet. 83:435 (1992), WO 2005012515 to Castle et. al. and WO 2005107437.

Resistance to herbicides that inhibit photosynthesis, such as a triazine (psbA and gs+ genes) or a benzonitrile (nitrilase gene), and glutathione S-transferase in Przibila et al., Plant Cell 3:169 (1991), U.S. Pat. No. 4,810,648, and Hayes et al., Biochem. J. 285:173 (1992).

Genes encoding Enzymes detoxifying the herbicide or a mutant glutamine synthase enzyme that is resistant to inhibition, e.g. n U.S. patent application Ser. No. 11/760,602. Or a detoxifying enzyme is an enzyme encoding a phosphinothricin acetyltransferase (such as the bar or pat protein from *Streptomyces* species). Phosphinothricin acetyltransferases are for example described in U.S. Pat. Nos. 5,561,236; 5,648,477; 5,646,024; 5,273,894; 5,637,489; 5,276,268; 5,739,082; 5,908,810 and 7,112,665.

Hydroxyphenylpyruvatedioxygenases (HPPD) inhibitors, naturally occuring HPPD resistant enzymes, or genes encoding a mutated or chimeric HPPD enzyme as described in WO 96/38567, WO 99/24585, and WO 99/24586, WO 2009/144079, WO 2002/046387, or U.S. Pat. No. 6,768,044.

4. Examples of Genes Involved in Abiotic Stress Tolerance

Transgene capable of reducing the expression and/or the activity of poly(ADP-ribose) polymerase (PARP) gene in the plant cells or plants as described in WO 00/04173 or, WO/2006/045633.

Transgenes capable of reducing the expression and/or the activity of the PARG encoding genes of the plants or plants cells, as described e.g. in WO 2004/090140.

Transgenes coding for a plant-functional enzyme of the nicotineamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphorybosyltransferase as described e.g. in EP 04077624.7, WO 2006/133827, PCT/EP07/002,433, EP 1999263, or WO 2007/107326.

Enzymes involved in carbohydrate biosynthesis include those described in e.g. EP 0571427, WO 95/04826, EP 0719338, WO 96/15248, WO 96/19581, WO 96/27674, WO 97/11188, WO 97/26362, WO 97/32985, WO 97/42328, WO 97/44472, WO 97/45545, WO 98/27212, WO 98/40503, WO99/58688, WO 99/58690, WO 99/58654, WO 00/08184, WO 00/08185, WO 00/08175, WO 00/28052, WO 00/77229, WO 01/12782, WO 01/12826, WO 02/101059, WO 03/071860, WO 2004/056999, WO 2005/030942, WO 2005/030941, WO 2005/095632, WO 2005/095617, WO 2005/095619, WO 2005/095618, WO 2005/123927, WO 2006/018319, WO 2006/103107, WO 2006/108702, WO 2007/009823, WO 00/22140, WO 2006/063862, WO 2006/072603, WO 02/034923, EP 06090134.5, EP 06090228.5, EP 06090227.7, EP 07090007.1, EP 07090009.7, WO 01/14569, WO 02/79410, WO 03/33540, WO 2004/078983, WO 01/19975, WO 95/26407, WO 96/34968, WO 98/20145, WO 99/12950, WO 99/66050, WO 99/53072, U.S. Pat. No. 6,734,341, WO 00/11192, WO 98/22604, WO 98/32326, WO 01/98509, WO 01/98509, WO 2005/002359, U.S. Pat. Nos. 5,824,790, 6,013,861, WO 94/04693, WO 94/09144, WO 94/11520, WO 95/35026 or WO 97/20936 or enzymes involved in the production of polyfructose, especially of the inulin and levan-type, as disclosed in EP 0663956, WO 96/01904, WO 96/21023, WO 98/39460, and WO 99/24593, the production of alpha-1,4-glucans as disclosed in WO 95/31553, US2002031826, U.S. Pat. Nos. 6,284,479, 5,712,107, WO 97/47806, WO 97/47807, WO 97/47808 and WO 00/14249, the production of alpha-1,6 branched alpha-1,4-glucans, as disclosed in WO 00/73422, the production of alternan, as disclosed in e.g. WO 00/47727, WO 00/73422, EP 06077301.7, U.S. Pat. No. 5,908,975 and EP 0728213, the production of hyaluronan, as for example disclosed in WO 2006/032538, WO 2007/039314, WO 2007/039315, WO 2007/039316, JP 2006304779, and WO 2005/012529.

Genes that improve drought resistance. For example, WO 2013122472 discloses that the absence or reduced level of functional Ubiquitin Protein Ligase protein (UPL) protein, more specifically, UPL3, leads to a decreased need for water or improved resistance to drought of said plant. Other examples of transgenic plants with increased drought tolerance are disclosed in, for example, US 2009/0144850, US 2007/0266453, and WO 2002/083911. US2009/0144850 describes a plant displaying a drought tolerance phenotype due to altered expression of a DR02 nucleic acid. US 2007/0266453 describes a plant displaying a drought tolerance phenotype due to altered expression of a DR03 nucleic acid and WO 2002/08391 1 describes a plant having an increased tolerance to drought stress due to a reduced activity of an ABC transporter which is expressed in guard cells. Another example is the work by Kasuga and co-authors (1999), who describe that overexpression of cDNA encoding DREB1 A in transgenic plants activated the expression of many stress tolerance genes under normal growing conditions and resulted in improved tolerance to drought, salt loading, and freezing. However, the expression of DREB1A also resulted in severe growth retardation under normal growing conditions (Kasuga (1999) Nat Biotechnol 17(3) 287-291).

In further particular embodiments, crop plants can be improved by influencing specific plant traits. For example, by developing pesticide-resistant plants, improving disease resistance in plants, improving plant insect and nematode resistance, improving plant resistance against parasitic weeds, improving plant drought tolerance, improving plant nutritional value, improving plant stress tolerance, avoiding self-pollination, plant forage digestibility biomass, grain yield etc. A few specific non-limiting examples are provided hereinbelow.

In addition to targeted mutation of single genes, CD-functionalized CRISPR system can be designed to allow targeted mutation of multiple genes, deletion of chromosomal fragment, site-specific integration of transgene, site-directed mutagenesis in vivo, and precise gene replacement or allele swapping in plants. Therefore, the methods described herein have broad applications in gene discovery and validation, mutational and cisgenic breeding, and hybrid breeding. These applications facilitate the production of a new generation of genetically modified crops with various improved agronomic traits such as herbicide resistance, disease resistance, abiotic stress tolerance, high yield, and superior quality.

Use of CD-Functionalized CRISPR System to Create Male Sterile Plants

Hybrid plants typically have advantageous agronomic traits compared to inbred plants. However, for self-pollinating plants, the generation of hybrids can be challenging. In different plant types, genes have been identified which are important for plant fertility, more particularly male fertility. For instance, in maize, at least two genes have been identified which are important in fertility (Amitabh Mohanty International Conference on New Plant Breeding Molecular Technologies Technology Development And Regulation, Oct. 9-10, 2014, Jaipur, India; Svitashev et al. Plant Physiol. 2015 October; 169(2): 931-45; Djukanovic et al. Plant J. 2013 December; 76(5): 888-99). The methods and systems provided herein can be used to target genes required for male fertility so as to generate male sterile plants which can easily be crossed to generate hybrids. In particular embodiments, the CD-functionalized CRISPR system provided herein is used for targeted mutagenesis of the cytochrome P450-like gene (MS26) or the meganuclease gene (MS45) thereby conferring male sterility to the maize plant. Maize plants which are as such genetically altered can be used in hybrid breeding programs.

Increasing the Fertility Stage in Plants

In particular embodiments, the methods and systems provided herein are used to prolong the fertility stage of a plant such as of a rice plant. For instance, a rice fertility stage gene such as Ehd3 can be targeted in order to generate a mutation in the gene and plantlets can be selected for a prolonged regeneration plant fertility stage (as described in CN 104004782)

Use of CD-Functionalized CRISPR System to Generate Genetic Variation in a Crop of Interest The availability of wild germplasm and genetic variations in crop plants is the key to crop improvement programs, but the available diversity in germplasms from crop plants is limited. The present invention envisages methods for generating a diversity of genetic variations in a germplasm of interest. In this application of the CD-functionalized CRISPR system a library of guide RNAs targeting different locations in the plant genome is provided and is introduced into plant cells together with the CRISPR-Cas protein and cytidine deaminase. In this way a collection of genome-scale point mutations and gene knock-outs can be generated. In particular embodiments, the methods comprise generating a plant part or plant from the cells so obtained and screening the cells for a trait of interest. The target genes can include both coding and non-coding regions. In particular embodiments, the trait is stress tolerance and the method is a method for the generation of stress-tolerant crop varieties Use of CD-Functionalized CRISPR to Affect Fruit-Ripening Ripening is a normal phase in the maturation process of fruits and vegetables. Only a few days after it starts it renders a fruit or vegetable inedible. This process brings significant losses to both farmers and consumers. In particular embodiments, the methods of the present invention are used to reduce ethylene production. This is ensured by ensuring one or more of the following: a. Suppression of ACC synthase gene expression. ACC (1-aminocyclopropane-1-carboxylic acid) synthase is the enzyme responsible for the conversion of S-adenosylmethionine (SAM) to ACC; the second to the last step in ethylene biosynthesis. Enzyme expression is hindered when an antisense (“mirror-image”) or truncated copy of the synthase gene is inserted into the plant’s genome; b. Insertion of the ACC deaminase gene. The gene coding for the enzyme is obtained from *Pseudomonas chlororaphis*, a common nonpathogenic soil *bacterium*. It converts ACC to a different compound thereby reducing the amount of ACC available for ethylene production; c. Insertion of the SAM hydrolase gene. This approach is similar to ACC deaminase wherein ethylene production is hindered when the amount of its precursor metabolite is reduced; in this case SAM is converted to homoserine. The gene coding for the enzyme is obtained from *E. coli* T3 bacteriophage and d. Suppression of ACC oxidase gene expression. ACC oxidase is the enzyme which catalyzes the oxidation of ACC to ethylene, the last step in the ethylene biosynthetic pathway. Using the methods described herein, down regulation of the ACC oxidase gene results in the suppression of ethylene production, thereby delaying fruit ripening. In particular embodiments, additionally or alternatively to the modifications described above, the methods described herein are used to modify ethylene receptors, so as to interfere with ethylene signals obtained by the fruit. In particular embodiments, expression of the ETRI gene, encoding an ethylene binding protein is modified, more particularly suppressed. In particular embodiments, additionally or alternatively to the modifications described above, the methods described herein are used to modify expression of the gene encoding Polygalacturonase (PG), which is the enzyme responsible for the breakdown of pectin, the substance that maintains the integrity of plant cell walls. Pectin breakdown occurs at the start of the ripening process resulting in the softening of the fruit. Accordingly, in particular embodiments, the methods described herein are used to introduce a mutation in the PG gene or to suppress activation of the PG gene in order to reduce the amount of PG enzyme produced thereby delaying pectin degradation.

Thus in particular embodiments, the methods comprise the use of the CD-functionalized CRISPR system to ensure one or more modifications of the genome of a plant cell such as described above and regenerating a plant therefrom. In particular embodiments, the plant is a tomato plant.

Increasing Storage Life of Plants

In particular embodiments, the methods of the present invention are used to modify genes involved in the production of compounds which affect storage life of the plant or plant part. More particularly, the modification is in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods provided herein are used to reduce or inhibit expression of the vacuolar invertase gene (VInv), which encodes a protein that breaks down sucrose to glucose and fructose (Clasen et al. DOI: 10.1111/pbi.12370).

The Use of the CD-Functionalized CRISPR System to Ensure a Value Added Trait

In particular embodiments the CD-functionalized CRISPR system is used to produce nutritionally improved agricultural crops. In particular embodiments, the methods provided herein are adapted to generate "functional foods", i.e. a modified food or food ingredient that may provide a health benefit beyond the traditional nutrients it contains and or "nutraceutical", i.e. substances that may be considered a food or part of a food and provides health benefits, including the prevention and treatment of disease. In particular embodiments, the nutraceutical is useful in the prevention and/or treatment of one or more of cancer, diabetes, cardiovascular disease, and hypertension.

Examples of nutritionally improved crops include (Newell-McGloughlin, Plant Physiology, July 2008, Vol. 147, pp. 939-953):

Modified protein quality, content and/or amino acid composition, such as have been described for Bahiagrass (Luciani et al. 2005, Florida Genetics Conference Poster), Canola (Roesler et al., 1997, Plant Physiol 113 75-81), Maize (Cromwell et al, 1967, 1969 J Anim Sci 26 1325-1331, O'Quin et al. 2000 J Anim Sci 78 2144-2149, Yang et al. 2002, Transgenic Res 11 11-20, Young et al. 2004, Plant J 38 910-922), Potato (Yu J and Ao, 1997 Acta Bot Sin 39 329-334; Chakraborty et al. 2000, Proc Natl Acad Sci USA 97 3724-3729; Li et al. 2001) Chin Sci Bull 46 482-484, Rice (Katsube et al. 1999, Plant Physiol 120 1063-1074), Soybean (Dinkins et al. 2001, Rapp 2002, In Vitro Cell Dev Biol Plant 37 742-747), Sweet Potato (Egnin and Prakash 1997, In Vitro Cell Dev Biol 33 52A).

Essential amino acid content, such as has been described for Canola (Falco et al. 1995, Bio/Technology 13 577-582), Lupin (White et al. 2001, J Sci Food Agric 81 147-154), Maize (Lai and Messing, 2002, Agbios 2008 GM crop database (Mar. 11, 2008)), Potato (Zeh et al. 2001, Plant Physiol 127 792-802), Sorghum (Zhao et al. 2003, Kluwer Academic Publishers, Dordrecht, The Netherlands, pp 413-416), Soybean (Falco et al. 1995 Bio/Technology 13 577-582; Galili et al. 2002 Crit Rev Plant Sci 21 167-204).

Oils and Fatty acids such as for Canola (Dehesh et al. (1996) Plant J 9 167-172 [PubMed]; Del Vecchio (1996) INFORM International News on Fats, Oils and Related Materials 7 230-243; Roesler et al. (1997) Plant Physiol 113 75-81 [PMC free article] [PubMed]; Froman and Ursin (2002, 2003) Abstracts of Papers of the American Chemical Society 223 U35; James et al. (2003) Am J Clin Nutr 77 1140-1145 [PubMed]; Agbios (2008, above); coton (Chapman et al. (2001). J Am Oil Chem Soc 78 941-947; Liu et al. (2002) J Am Coll Nutr 21 205S-211S [PubMed]; O'Neill (2007) Australian Life Scientist. http://www.biotech-news.com.au/index.php/id; 866694817; fp; 4; fpid; 2 (Jun. 17, 2008), Linseed (Abbadi et al., 2004, Plant Cell 16:2734-2748), Maize (Young et al., 2004, Plant J 38 910-922), oil palm (Jalani et al. 1997, J Am Oil Chem Soc 74 1451-1455; Parveez, 2003, AgBiotechNet 113 1-8), Rice (Anai et al., 2003, Plant Cell Rep 21 988-992), Soybean (Reddy and Thomas, 1996, Nat Biotechnol 14 639-642; Kinney and Kwolton, 1998, Blackie Academic and Professional, London, pp 193-213), Sunflower (Arcadia, Biosciences 2008)

Carbohydrates, such as Fructans described for Chicory (Smeekens (1997) Trends Plant Sci 2 286-287, Sprenger et al. (1997) FEBS Lett 400 355-358, Sévenier et al. (1998) Nat Biotechnol 16 843-846), Maize (Caimi et al. (1996) Plant Physiol 110 355-363), Potato (Hellwege et al., 1997 Plant J 12 1057-1065), Sugar Beet (Smeekens et al. 1997, above), Inulin, such as described for Potato (Hellewege et al. 2000, Proc Natl Acad Sci USA 97 8699-8704), Starch, such as described for Rice (Schwall et al. (2000) Nat Biotechnol 18 551-554, Chiang et al. (2005) Mol Breed 15 125-143), Vitamins and carotenoids, such as described for Canola (Shintani and DellaPenna (1998) Science 282 2098-2100), Maize (Rocheford et al. (2002). J Am Coll Nutr 21 191S-198S, Cahoon et al. (2003) Nat Biotechnol 21 1082-1087, Chen et al. (2003) Proc Natl Acad Sci USA 100 3525-3530), Mustardseed (Shewmaker et al. (1999) Plant J 20 401-412, Potato (Ducreux et al., 2005, J Exp Bot 56 81-89), Rice (Ye et al. (2000) Science 287 303-305, Strawberry (Agius et al. (2003), Nat Biotechnol 21 177-181), Tomato (Rosati et al. (2000) Plant J 24 413-419, Fraser et al. (2001) J Sci Food Agric 81 822-827, Mehta et al. (2002) Nat Biotechnol 20 613-618, Díaz de la Garza et al. (2004) Proc Natl Acad Sci USA 101 13720-13725, Enfissi et al. (2005) Plant Biotechnol J 3 17-27, DellaPenna (2007) Proc Natl Acad Sci USA 104 3675-3676.

Functional secondary metabolites, such as described for Apple (stilbenes, Szankowski et al. (2003) Plant Cell Rep 22:141-149), Alfalfa (resveratrol, Hipskind and Paiva (2000) Mol Plant Microbe Interact 13 551-562), Kiwi (resveratrol, Kobayashi et al. (2000) Plant Cell Rep 19 904-910), Maize and Soybean (flavonoids, Yu et al. (2000) Plant Physiol 124 781-794), Potato (anthocyanin and alkaloid glycoside, Lukaszewicz et al. (2004) J Agric Food Chem 52 1526-1533), Rice (flavonoids & resveratrol, Stark-Lorenzen et al. (1997) Plant Cell Rep 16 668-673, Shin et al. (2006) Plant Biotechnol J 4 303-315), Tomato (+resveratrol, chlorogenic acid, flavonoids, stilbene; Rosati et al. (2000) above, Muir et al. (2001) Nature 19 470-474, Niggeweg et al. (2004) Nat Biotechnol 22 746-754, Giovinazzo et al. (2005) Plant Biotechnol J 3 57-69), wheat (caffeic and ferulic acids, resveratrol; United Press International (2002)); and Mineral availabilities such as described for Alfalfa (phytase, Austin-Phillips et al. (1999) http://www.molecularfarming.com/nonmedical.html), Lettuse (iron, Goto et al. (2000) Theor Appl Genet 100 658-664), Rice (iron, Lucca et al. (2002) J Am Coll Nutr 21 184S-190S), Maize, Soybean and wheate (phytase, Drakakaki et al. (2005) Plant Mol Biol 59 869-880, Denbow et al. (1998) Poult Sci 77 878-881, Brinch-Pedersen et al. (2000) Mol Breed 6 195-206).

In particular embodiments, the value-added trait is related to the envisaged health benefits of the compounds present in the plant. For instance, in particular embodiments, the value-added crop is obtained by applying the methods of the invention to ensure the modification of or induce/increase the synthesis of one or more of the following compounds:

Carotenoids, such as α-Carotene present in carrots which Neutralizes free radicals that may cause damage to cells or β-Carotene present in various fruits and vegetables which neutralizes free radicals Lutein present in green vegetables which contributes to maintenance of healthy vision Lycopene present in tomato and tomato products, which is believed to reduce the risk of prostate cancer Zeaxanthin, present in citrus and maize, which contributes to mainteance of healthy vision Dietary fiber such as insoluble fiber present in wheat bran which may reduce the risk of breast and/or colon cancer and β-Glucan present in oat, soluble fiber present in Psylium and whole cereal grains which may reduce the risk of cardiovascular disease (CVD)

Fatty acids, such as ω-3 fatty acids which may reduce the risk of CVD and improve mental and visual functions, Conjugated linoleic acid, which may improve body composition, may decrease risk of certain cancers and GLA which may reduce inflammation risk of cancer and CVD, may improve body composition Flavonoids such as Hydroxycinnamates, present in wheat which have Antioxidant-like activities, may reduce risk of degenerative diseases, flavonols, catechins and tannins present in fruits and vegetables which neutralize free radicals and may reduce risk of cancer Glucosinolates, indoles, isothiocyanates, such as Sulforaphane, present in Cruciferous vegetables (broccoli, kale), horseradish, which neutralize free radicals, may reduce risk of cancer Phenolics, such as stilbenes present in grape which May reduce risk of degenerative diseases, heart disease, and cancer, may have longevity effect and caffeic acid and ferulic acid present in vegetables and citrus which have Antioxidant-like activities, may reduce risk of degenerative diseases, heart disease, and eye disease, and epicatechin present in cacao which has Antioxidant-like activities, may reduce risk of degenerative diseases and heart disease Plant stanols/sterols present in maize, soy, wheat and wooden oils which May reduce risk of coronary heart disease by lowering blood cholesterol levels Fructans, inulins, fructo-oligosaccharides present in Jerusalem artichoke, shallot, onion powder which may improve gastrointestinal health Saponins present in soybean, which may lower LDL cholesterol Soybean protein present in soybean which may reduce risk of heart disease Phytoestrogens such as isoflavones present in soybean which May reduce menopause symptoms, such as hot flashes, may reduce osteoporosis and CVD and lignans present in flax, rye and vegetables, which May protect against heart disease and some cancers, may lower LDL cholesterol, total cholesterol.

Sulfides and thiols such as diallyl sulphide present in onion, garlic, olive, leek and scallon and Allyl methyl trisulfide, dithiolthiones present in cruciferous vegetables which may lower LDL cholesterol, helps to maintain healthy immune system Tannins, such as proanthocyanidins, present in cranberry, cocoa, which may improve urinary tract health, may reduce risk of CVD and high blood pressure.

In addition, the methods of the present invention also envisage modifying protein/starch functionality, shelf life, taste/aesthetics, fiber quality, and allergen, antinutrient, and toxin reduction traits.

Accordingly, the invention encompasses methods for producing plants with nutritional added value, said methods comprising introducing into a plant cell a gene encoding an enzyme involved in the production of a component of added nutritional value using the CD-functionalized CRISPR system as described herein and regenerating a plant from said plant cell, said plant characterized in an increase expression of said component of added nutritional value. In particular embodiments, the CD-functionalized CRISPR system is used to modify the endogenous synthesis of these compounds indirectly, e.g. by modifying one or more transcription factors that controls the metabolism of this compound. Methods for introducing a gene of interest into a plant cell and/or modifying an endogenous gene using the CD-functionalized CRISPR system are described herein above.

Some specific examples of modifications in plants that have been modified to confer value-added traits are: plants with modified fatty acid metabolism, for example, by transforming a plant with an antisense gene of stearyl-ACP desaturase to increase stearic acid content of the plant. See Knultzon et al., Proc. Natl. Acad. Sci. U.S.A. 89:2624 (1992). Another example involves decreasing phytate content, for example by cloning and then reintroducing DNA associated with the single allele which may be responsible for maize mutants characterized by low levels of phytic acid. See Raboy et al, Maydica 35:383 (1990).

Similarly, expression of the maize (*Zea mays*) Tfs Cl and R, which regulate the production of flavonoids in maize aleurone layers under the control of a strong promoter, resulted in a high accumulation rate of anthocyanins in *Arabidopsis* (*Arabidopsis thaliana*), presumably by activating the entire pathway (Bruce et al., 2000, Plant Cell 12:65-80). DellaPenna (Welsch et al., 2007 Annu Rev Plant Biol 57:711-738) found that Tf RAP2.2 and its interacting partner SINAT2 increased carotenogenesis in *Arabidopsis* leaves. Expressing the Tf Dof1 induced the up-regulation of genes encoding enzymes for carbon skeleton production, a marked increase of amino acid content, and a reduction of the Glc level in transgenic *Arabidopsis* (Yanagisawa, 2004 Plant Cell Physiol 45:386-391), and the DOF Tf AtDof1.1 (OBP2) up-regulated all steps in the glucosinolate biosynthetic pathway in *Arabidopsis* (Skirycz et al., 2006 Plant J 47:10-24).

Reducing Allergen in Plants

In particular embodiments the methods provided herein are used to generate plants with a reduced level of allergens, making them safer for the consumer. In particular embodiments, the methods comprise modifying expression of one or more genes responsible for the production of plant allergens. For instance, in particular embodiments, the methods comprise down-regulating expression of a Lol p5 gene in a plant cell, such as a ryegrass plant cell and regenerating a plant therefrom so as to reduce allergenicity of the pollen of said plant (Bhalla et al. 1999, Proc. Natl. Acad. Sci. USA Vol. 96:11676-11680).

Peanut allergies and allergies to legumes generally are a real and serious health concern. The CD-functionalized CRISPR system of the present invention can be used to identify and then mutate genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3): 222).

Screening Methods for Endogenous Genes of Interest

The methods provided herein further allow the identification of genes of value encoding enzymes involved in the production of a component of added nutritional value or generally genes affecting agronomic traits of interest, across species, phyla, and plant kingdom. By selectively targeting e.g. genes encoding enzymes of metabolic pathways in plants using the CD-functionalized CRISPR system as described herein, the genes responsible for certain nutritional aspects of a plant can be identified. Similarly, by selectively targeting genes which may affect a desirable agronomic trait, the relevant genes can be identified. Accordingly, the present invention encompasses screening methods for genes encoding enzymes involved in the production of compounds with a particular nutritional value and/or agronomic traits.

Further Applications of the CD-Functionalized CRISPR System in Plants and Yeasts Use of CD-Functionalized CRISPR System in Biofuel Production The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the CD-functionalized CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCOAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). More particularly, the methods disclosed herein are used to generate mutations in homologs to CasIL to reduce polysaccharide acetylation.

Modifying Yeast for Biofuel Production

In particular embodiments, the CD-functionalized CRISPR system provided herein is used for bioethanol production by recombinant micro-organisms. For instance, the CD-functionalized CRISPR system can be used to engineer micro-organisms, such as yeast, to generate biofuel or biopolymers from fermentable sugars and optionally to be able to degrade plant-derived lignocellulose derived from agricultural waste as a source of fermentable sugars. In some embodiments, the CD-functionalized CRISPR system is used to modify endogenous metabolic pathways which compete with the biofuel production pathway.

Accordingly, in more particular embodiments, the methods described herein are used to modify a micro-organism as follows: to modify at least one nucleic acid encoding for an enzyme in a metabolic pathway in said host cell, wherein said pathway produces a metabolite other than acetaldehyde from pyruvate or ethanol from acetaldehyde, and wherein said modification results in a reduced production of said metabolite, or to introduce at least one nucleic acid encoding for an inhibitor of said enzyme.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

According to particular embodiments of the invention, the CD-functionalized CRISPR system is used to generate lipid-rich diatoms which are useful in biofuel production.

In particular embodiments it is envisaged to specifically modify genes that are involved in the modification of the quantity of lipids and/or the quality of the lipids produced by the algal cell. Examples of genes encoding enzymes involved in the pathways of fatty acid synthesis can encode proteins having for instance acetyl-CoA carboxylase, fatty acid synthase, 3-ketoacyl_acyl-carrier protein synthase III, glycerol-3-phospate deshydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid:diacylglycerol acyltransferase, phoshatidate phosphatase, fatty acid thioesterase such as palmitoyi protein thioesterase, or malic enzyme activities. In further embodiments it is envisaged to generate diatoms that have increased lipid accumulation. This can be achieved by targeting genes that decrease lipid catabolisation. Of particular interest for use in the methods of the present invention are genes involved in the activation of both triacylglycerol and free fatty acids, as well as genes directly involved in β-oxidation of fatty acids, such as acyl-CoA synthetase, 3-ketoacyl-CoA thiolase, acyl-CoA oxidase activity and phosphoglucomutase. The CD-functionalized CRISPR system and methods described herein can be used to specifically activate such genes in diatoms as to increase their lipid content.

Organisms such as microalgae are widely used for synthetic biology. Stovicek et al. (Metab. Eng. Comm., 2015; 2:13 describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and guide RNA were expressed from genomic or episomal 2μ-based vector locations. The authors also showed that gene disruption efficiency could be improved by optimization of the levels of Cas9 and guide RNA expression. Hlavová et al. (Biotechnol. Adv. 2015) discusses development of species or strains of microalgae using techniques such as CRISPR to target nuclear and chloroplast genes for insertional mutagenesis and screening.

U.S. Pat. No. 8,945,839 describes a method for engineering Micro-Algae (*Chlamydomonas reinhardtii* cells) species) using Cas9. Using similar tools, the methods of the CD-functionalized CRISPR system described herein can be applied on *Chlamydomonas* species and other algae. In particular embodiments, a CRISPR-Cas protein (e.g., Cas13), cytidine deaminase (which may be fused to the CRISPR-Cas protein or an aptamer-binding adaptor protein), and guide RNA are introduced in algae expressed using a vector that expresses the CRISPR-Cas protein and optionally the cytidine deaminase under the control of a constitutive promoter such as Hsp70A-Rbc S2 or Beta2-tubulin. Guide RNA will be delivered using a vector containing T7 promoter. Alternatively, mRNA and in vitro transcribed guide RNA can be delivered to algal cells. Electroporation protocol follows standard recommended protocol from the GeneArt *Chlamydomonas* Engineering kit.

The Use of CD-Functionalized CRISPR System in the Generation of Micro-Organisms Capable of Fatty Acid Production In particular embodiments, the methods of the invention are used for the generation of genetically engineered micro-organisms capable of the production of fatty esters, such as fatty acid methyl esters ("FAME") and fatty acid ethyl esters ("FAEE"), Typically, host cells can be engineered to produce fatty esters from a carbon source, such as an alcohol, present in the medium, by expression or overexpression of a gene encoding a thioesterase, a gene encoding an acyl-CoA synthase, and a gene encoding an ester synthase. Accordingly, the methods provided herein are used to modify a micro-organisms so as to overexpress or introduce a thioesterase gene, a gene encloding an acyl-CoA synthase, and a gene encoding an ester synthase. In particular embodiments, the thioesterase gene is selected from tesA, 'tesA, tesB, fatB, fatB2, fatB3,fatA1, or fatA. In particular embodiments, the gene encoding an acyl-CoA synthase is selected from fadDJadK, BH3103, pfl-4354, EAV15023, fadD1, fadD2, RPC_4074, fadDD35, fadDD22, faa39, or an identified gene encoding an enzyme having the same properties. In particular embodiments, the gene encoding an ester synthase is a gene encoding a synthase/acyl-CoA:diacylglycerl acyltransferase from *Simmondsia chinensis, Acinetobacter* sp. ADP, *Alcanivorax borkumensis, Pseudomonas aeruginosa, Fundibacter jadensis, Arabidopsis thaliana*, or *Alkaligenes eutrophus*, or a variant thereof.

Additionally or alternatively, the methods provided herein are used to decrease expression in said micro-organism of of at least one of a gene encoding an acyl-CoA dehydrogenase, a gene encoding an outer membrane protein receptor, and a gene encoding a transcriptional regulator of fatty acid biosynthesis. In particular embodiments one or more of these genes is inactivated, such as by introduction of a mutation. In particular embodiments, the gene encoding an acyl-CoA dehydrogenase is fadE. In particular embodiments, the gene encoding a transcriptional regulator of fatty acid biosynthesis encodes a DNA transcription repressor, for example, fabR.

Additionally or alternatively, said micro-organism is modified to reduce expression of at least one of a gene encoding a pyruvate formate lyase, a gene encoding a lactate dehydrogenase, or both. In particular embodiments, the gene encoding a pyruvate formate lyase is pflB. In particular embodiments, the gene encoding a lactate dehydrogenase is IdhA. In particular embodiments one or more of these genes is inactivated, such as by introduction of a mutation therein.

In particular embodiments, the micro-organism is selected from the genus *Escherichia, Bacillus, Lactobacillus, Rhodococcus, Synechococcus, Synechoystis, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia*, or *Streptomyces.*

The Use of CD-Functionalized CRISPR System in the Generation of Micro-Organisms Capable of Organic Acid Production The methods provided herein are further used to engineer micro-organisms capable of organic acid production, more particularly from pentose or hexose sugars. In particular embodiments, the methods comprise introducing into a micro-organism an exogenous LDH gene. In particular embodiments, the organic acid production in said micro-organisms is additionally or alternatively increased by inactivating endogenous genes encoding proteins involved in an endogenous metabolic pathway which produces a metabolite other than the organic acid of interest and/or wherein the endogenous metabolic pathway consumes the organic acid. In particular embodiments, the modification ensures that the production of the metabolite other than the organic acid of interest is reduced. According to particular embodiments, the methods are used to introduce at least one engineered gene deletion and/or inactivation of an endogenous pathway in which the organic acid is consumed or a gene encoding a product involved in an endogenous pathway which produces a metabolite other than the organic acid of interest. In particular embodiments, the at least one engineered gene deletion or inactivation is in one or more gene encoding an enzyme selected from the group consisting of pyruvate decarboxylase (pdc), fumarate reductase, alcohol dehydrogenase (adh), acetaldehyde dehydrogenase, phosphoenolpyruvate carboxylase (ppc), D-lactate dehydrogenase (d-ldh), L-lactate dehydrogenase (l-ldh), lactate 2-monooxygenase. In further embodiments the at least one engineered gene deletion and/or inactivation is in an endogenous gene encoding pyruvate decarboxylase (pdc).

In further embodiments, the micro-organism is engineered to produce lactic acid and the at least one engineered gene deletion and/or inactivation is in an endogenous gene encoding lactate dehydrogenase. Additionally or alternatively, the micro-organism comprises at least one engineered gene deletion or inactivation of an endogenous gene encoding a cytochrome-dependent lactate dehydrogenase, such as a cytochrome B2-dependent L-lactate dehydrogenase.

The Use of CD-Functionalized CRISPR System in the Generation of Improved Xylose or Cellobiose Utilizing Yeasts Strains In particular embodiments, the CD-functionalized CRISPR system may be applied to select for improved xylose or cellobiose utilizing yeast strains. Error-prone PCR can be used to amplify one (or more) genes involved in the xylose utilization or cellobiose utilization pathways.

Examples of genes involved in xylose utilization pathways and cellobiose utilization pathways may include, without limitation, those described in Ha, S. J., et al. (2011) Proc. Natl. Acad. Sci. USA 108(2): 504-9 and Galazka, J. M., et al. (2010) Science 330(6000): 84-6. Resulting libraries of double-stranded DNA molecules, each comprising a random mutation in such a selected gene could be co-transformed with the components of the CD-functionalized CRISPR system into a yeast strain (for instance S288C) and strains can be selected with enhanced xylose or cellobiose utilization capacity, as described in WO2015138855.

The Use of CD-Functionalized CRISPR System in the Generation of Improved Yeasts Strains for Use in Isoprenoid Biosynthesis Tadas Jakočiūnas et al. described the successful application of a multiplex CRISPR-Cas9 system for genome engineering of up to 5 different genomic loci in one transformation step in baker's yeast *Saccharomyces cerevisiae* (Metabolic Engineering Volume 28, March 2015, Pages 213-222) resulting in strains with high mevalonate production, a key intermediate for the industrially important isoprenoid biosynthesis pathway. In particular embodiments, the CD-functionalized CRISPR system may be applied in a multiplex genome engineering method as described herein for identifying additional high producing yeast strains for use in isoprenoid synthesis.

Improved Plants and Yeast Cells

The present invention also provides plants and yeast cells obtainable and obtained by the methods provided herein. The improved plants obtained by the methods described herein may be useful in food or feed production through expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants.

The methods for genome editing using the CD-functionalized CRISPR system as described herein can be used to confer desired traits on essentially any plant, algae, fungus, yeast, etc. A wide variety of plants, algae, fungus, yeast, etc and plant algae, fungus, yeast cell or tissue systems may be engineered for the desired physiological and agronomic characteristics described herein using the nucleic acid constructs of the present disclosure and the various transformation methods mentioned above.

In particular embodiments, the methods described herein are used to modify endogenous genes or to modify their expression without the permanent introduction into the genome of the plant, algae, fungus, yeast, etc of any foreign gene, including those encoding CRISPR components, so as to avoid the presence of foreign DNA in the genome of the plant. This can be of interest as the regulatory requirements for non-transgenic plants are less rigorous.

The methods described herein generally result in the generation of "improved plants, algae, fungi, yeast, etc" in that they have one or more desirable traits compared to the wildtype plant. In particular embodiments, non-transgenic genetically modified plants, algae, fungi, yeast, etc., parts or cells are obtained, in that no exogenous DNA sequence is incorporated into the genome of any of the cells of the plant. In such embodiments, the improved plants, algae, fungi, yeast, etc. are non-transgenic. Where only the modification of an endogenous gene is ensured and no foreign genes are introduced or maintained in the plant, algae, fungi, yeast, etc. genome, the resulting genetically modified crops contain no foreign genes and can thus basically be considered non-transgenic. The different applications of the CD-functionalized CRISPR system for plant, algae, fungi, yeast, etc. genome editing include, but are not limited to: editing of endogenous genes to confer an agricultural trait of interest. Examplary genes conferring agronomic traits include, but are not limited to genes that confer resistance to pests or diseases; genes involved in plant diseases, such as those listed in WO 2013046247; genes that confer resistance to herbicides, fungicides, or the like; genes involved in (abiotic) stress tolerance. Other aspects of the use of the CRISPR-Cas system include, but are not limited to: create (male) sterile plants; increasing the fertility stage in plants/algae etc; generate genetic variation in a crop of interest; affect fruit-ripening; increasing storage life of plants/algae etc; reducing allergen in plants/algae etc; ensure a value added trait (e.g. nutritional improvement); Sscreening methods for endogenous genes of interest; biofuel, fatty acid, organic acid, etc production.

CD-Functionalized CRISPR System can be Used in Non-Human Organisms

In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20; 111(20): 7260-5) utilized a reporter-guided transcription activator-like effector nuclease (TALEN) system to generated targeted modifications of recombination activating gene (RAG) 2 in somatic cells at high efficiency, including some that affected both alleles. The CD-functionalized CRISPR system may be applied to a similar system.

The methods of Lee et al., (Proc Natl Acad Sci USA. 2014 May 20; 111(20): 7260-5) may be applied to the present invention analogously as follows. Mutated pigs are produced by targeted modification of RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 are screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell are placed in the perivitelline. The reconstructed embryos are then electrically porated to fuse the donor cell with the oocyte and then chemically activated. The activated embryos are incubated in Porcine Zygote Medium 3 (PZM3) with 0.5 μM Scriptaid (S7817; Sigma-Aldrich) for 14-16 h. Embryos are then washed to remove the Scriptaid and cultured in PZM3 until they were transferred into the oviducts of surrogate pigs.

The present invention is also applicable to modifying SNPs of other animals, such as cows. Tan et al. (Proc Natl Acad Sci USA. 2013 Oct. 8; 110(41): 16526-16531) expanded the livestock gene editing toolbox to include transcription activator-like (TAL) effector nuclease (TALEN)- and clustered regularly interspaced short palindromic repeats (CRISPR)/Cas9-stimulated homology-directed repair (HDR) using plasmid, rAAV, and oligonucleotide templates. Gene specific guide RNA sequences were cloned into the Church lab guide RNA vector (Addgene ID: 41824) according to their methods (Mali P, et al. (2013) RNA-Guided Human Genome Engineering via Cas9. Science 339(6121): 823-826). The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI-AgeI fragment from the hCas9 plasmid (encompassing the hCas9 cDNA) into the RCIScript plasmid.

Heo et al. (Stem Cells Dev. 2015 Feb. 1; 24(3): 393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generate induced pluripotent stem cells (iPSCs) from bovine somatic fibroblasts by the ectopic expression of yamanaka factors and GSK3β and MEK inhibitor (2i) treatment. Heo et al. observed that these bovine iPSCs are highly similar to naïve pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle e Genome Coordination Program (www.animalgenome.org/cattle/maps/db.html). Thus, the present invention maybe applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting targeting the first exon of the dog Myostatin (MSTN) gene (a negative regulator of skeletal muscle mass). First, the efficiency of the sgRNA was validated, using cotransfection of the the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and auto-transplantation of the zygotes into the oviduct of the same female dog. The knock-out puppies displayed an obvious muscular phenotype on thighs compared with its wild-type littermate sister. This can also be performed using the CD-functionalized CRISPR systems provided herein.

Livestock-Pigs

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e. a CD163 knock out.

Accordingly, in some embodiments, porcine alveolar macrophages may be targeted by the CRISPR protein. In some embodiments, porcine CD163 may be targeted by the CRISPR protein. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock, breeding or modelling purposes (i.e. a porcine model). Semen comprising the gene knock out is also provided.

CD163 is a member of the scavenger receptor cysteine-rich (SRCR) superfamily. Based on in vitro studies SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, HIN2, H2N1, H3N1, H3N2, and H2N3, as well as pneumonia, meningitis and oedema mentioned above.

In some embodiments, the CD-functionalized CRISPR system described herein can be used to genetically modify a pig genome to inactivate one or more porcine endogenous retrovirus (PERVs) loci to facilitate clinical application of porcine-to-human xenotransplantation. See Yang et al., *Science* 350(6264): 1101-1104 (2015), which is incorporated herein by reference in its entirety. In some embodiments, the CD-functionalized CRISPR system described herein can be used to produce a genetically modified pig that does not comprise any active porcine endogenous retrovirus (PERVs) locus.

Therapeutic Targeting with CD-Functionalized CRISPR System

As will be apparent, it is envisaged that CD-functionalized CRISPR system can be used to target any polynucleotide sequence of interest. The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy. Additional diseases that may be treated using the compositions and methods of the present invention are are further disclosed in ClinVar database (Landrum et al., Nucleic Acids Res. 2016 Jan. 4; 44 (D1): D862-8; Landrum et al., Nucleic Acids Res. 2014 Jan. 1; 42(1): D980-5; http://www.ncbi.nlm.nih.gov/books/NBK174587/).

Adoptive Cell Therapies

The present invention also contemplates use of the CD-functionalized CRISPR system described herein to modify cells for adoptive therapies. Aspects of the invention accordingly involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32:189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144). Various strategies may for example be employed to genetically modify T cells by altering the specificity of the T cell receptor (TCR) for example by introducing new TCR α and β chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8a hinge domain and a CD8a transmembrane domain, to the transmembrane and intracellular signaling domains of either CD3 or FcRy (scFv-CD3 or scFv-FcRy; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761).

Third-generation CARs include a combination of costimulatory endodomains, such a CD3ζ-chain, CD97, GDI 1a-CD18, CD2, ICOS, CD27, CD154, CDS, OX40, 4-1BB, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native aβTCR, for example by antigen on professional antigen-presenting cells, with attendant costimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using $2^{nd}$ generation antigen-specific CARs signaling through CD3g and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to threat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

In one embodiment, the treatment can be administrated into patients undergoing an immunosuppressive treatment. The cells or population of cells, may be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges. Dosing in CAR T cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6:95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6): 1107-15 (2010)).

In a further refinement of adoptive therapies, genome editing with a CD-functionalized CRISPR-Cas system as described herein may be used to tailor immunoresponsive cells to alternative implementations, for example providing edited CAR T cells (see Poirot et al., 2015, Multiplex genome edited T-cell manufacturing platform for “off-the-shelf” adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Cells may be edited using a CD-functionalized CRISPR system as described herein. CD-functionalized CRISPR systems may be delivered to an immune cell by any method described herein. In preferred embodiments, cells are edited ex vivo and transferred to a subject in need thereof. Immunoresponsive cells, CAR-T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

T cell receptors (TCR) are cell surface receptors that participate in the activation of T cells in response to the presentation of antigen. The TCR is generally made from two chains, α and β, which assemble to form a heterodimer and associates with the CD3-transducing subunits to form the T cell receptor complex present on the cell surface. Each α and β chain of the TCR consists of an immunoglobulin-like N-terminal variable (V) and constant (C) region, a hydrophobic transmembrane domain, and a short cytoplasmic region. As for immunoglobulin molecules, the variable region of the α and β chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD. However, TCR disruption generally results in the elimination of the CD3 signaling component and alters the means of further T cell expansion.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1; 112(12): 4746-54). Thus, to prevent rejection of allogeneic cells, the host’s immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCDI). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2): 356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244(2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDMI, BATF, VISTA, GUCY1A2, GUCY1A3, GUCY1B2, GUCY1B3, MT1, MT2, CD40, OX40, CD137, GITR, CD27, SHP-1 or TIM-3. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCR$\alpha$, PD1 and TCR$\beta$, CTLA-4 and TCR$\alpha$, CTLA-4 and TCR$\beta$, LAG3 and TCR$\alpha$, LAG3 and TCR$\beta$, Tim3 and TCR$\alpha$, Tim3 and TCR$\beta$, BTLA and TCR$\alpha$, BTLA and TCR$\beta$, BY55 and TCR$\alpha$, BY55 and TCR$\beta$, TIGIT and TCR$\alpha$, TIGIT and TCR$\beta$, B7H5 and TCR$\alpha$, B7H5 and TCR$\beta$, LAIR1 and TCR$\alpha$, LAIR1 and TCR$\beta$, SIGLEC10 and TCR$\alpha$, SIGLEC10 and TCR$\beta$, 2B4 and TCR$\alpha$, 2B4 and TCR$\beta$.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

The practice of the present invention employs techniques known in the field of immunology, biochemistry, chemistry, molecular biology, microbiology, cell biology, genomics and recombinant DNA, which are within the skill of the art. See MOLECULAR CLONING: A LABORATORY MANUAL, 2nd edition (1989) (Sambrook, Fritsch and Maniatis); MOLECULAR CLONING: A LABORATORY MANUAL, 4th edition (2012) (Green and Sambrook); CURRENT PROTOCOLS IN MOLECULAR BIOLOGY (1987) (F. M. Ausubel, et al. eds.); the series METHODS IN ENZYMOLOGY (Academic Press, Inc.); PCR 2: A PRACTICAL APPROACH (1995) (M. J. MacPherson, B. D. Hames and G. R. Taylor eds.); ANTIBODIES, A LABORATORY MANUAL (1988) (Harlow and Lane, eds.); ANTIBODIES A LABORATORY MANUAL, 2nd edition (2013) (E. A. Greenfield ed.); and ANIMAL CELL CULTURE (1987) (R. I. Freshney, ed.).

Correction of Disease-Associated Mutations and Pathogenic SNPs

In one aspect, the invention described herein provides methods for modifying an cytidine residue at a target locus with the aim of remedying and/or preventing a diseased condition that is or is likely to be caused by a T(U)-to-C or A-to-G point mutation or a pathogenic single nucleotide polymorphism (SNP).

Pathogenic T(U)-to-C or A-to-G mutations/SNPs associated with various diseases are reported in the Clin Var database, including but not limited to genetic diseases, cancer, metabolic diseases, or lysosomal storage diseases. Accordingly, an aspect of the invention relates to a method for correcting one or more pathogenic T(U)-to-C or A-to-G mutations/SNPs associated with any of these diseases, as discussed below.

In some embodiments, the methods, systems, and compositions described herein are used to correct one or more pathogenic T(U)-to-C or A-to-G mutations/SNPs reported in the Clin Var database. In some embodiments, the methods, systems, and compositions described herein are used to correct one or more pathogenic T(U)-to-C or A-to-G mutations/SNPs associated with any of the diseases or disorders disclosed in WO2017/070632, titled "Nucleobase Editor and Uses Thereof," which is incorporated herein by reference in its entirety. Exemplary diseases or disorders that may be treated include, without limitation, 3-Methylglutaconic aciduria type 2, 46, XY gonadal dysgenesis, 4-Alpha-hydroxyphenylpyruvate hydroxylase deficiency, 6-pyruvoyl-tetrahydropterin synthase deficiency, achromatopsia, Acid-labile subunit deficiency, Acrodysostosis, acroerythrokeratoderma, ACTH resistance, ACTH-independent macronodular adrenal hyperplasia, Activated PBK-delta syndrome, Acute intermittent *porphyria*, Acute myeloid leukemia, Adams-Oliver syndrome 1/5/6, Adenylosuccinate lyase deficiency, Adrenoleukodystrophy, Adult neuronal ceroid lipofuscinosis, Adult onset ataxia with oculomotor apraxia, Advanced sleep phase syndrome, Age-related macular degeneration, Alagille syndrome, Alexander disease, Allan-Herndon-Dudley syndrome, Alport syndrome, X-linked recessive, Alternating hemiplegia of childhood, Alveolar capillary dysplasia with misalignment of pulmonary veins, Amelogenesis imperfecta, Amyloidogenic transthyretin amyloidosis, Amyotrophic lateral sclerosis, Anemia (nonspherocytic hemolytic, due to G6PD deficiency), Anemia (sideroblastic, pyridoxine-refractory, autosomal recessive), Anonychia, Antithrombin III deficiency, Aortic aneurysm, Aplastic anemia, Apolipoprotein C2 deficiency, Apparent mineralocorticoid excess, Aromatase deficiency, Arrhythmogenic right ventricular cardiomyopathy, Familial hypertrophic cardiomyopathy, Hypertrophic c cardiomyopathy, Arthrogryposis multiplex congenital, Aspartylglycosaminuria, Asphyxiating thoracic dystrophy, Ataxia with vitamin E deficiency, Ataxia (spastic), Atrial fibrillation, Atrial septal defect, atypical hemolytic-uremic syndrome, autosomal dominant CD11C+/CD1C+ dendritic cell deficiency, Autosomal dominant progressive external ophthalmoplegia with mitochondrial DNA deletions, Baraitser-Winter syndrome, Bartter syndrome, Basa ganglia calcification, Beckwith-Wiedemann syndrome, Benign familial neonatal seizures, Benign scapuloperoneal muscular dystrophy, Bernard Soulier syndrome, Beta thalassemia *intermedia*, Beta-D-mannosidosis, Bietti crystalline corneoretinal dystrophy, Bile acid malabsorption, Biotinidase deficiency, Borjeson-Forssman-Lehmann syndrome, Boucher Neuhauser syndrome, Bowen-Conradi syndrome, Brachydactyly, Brown-Vialetto-Van laere syndrome, Brugada syndrome, Cardiac arrhythmia, Cardiofaciocutaneous syndrome, Cardiomyopathy, Carnevale syndrome, Carnitine palmitoyltransferase II deficiency, Carpenter syndrome, Cataract, Catecholaminergic polymorphic ventricular tachycardia, Central core disease, Centromeric instability of chromosomes 1,9 and 16 and immunodeficiency, Cerebral autosomal dominant arteriopathy, Cerebro-oculo-facio-skeletal syndrome, Ceroid lipofuscinosis, Charcot-Marie-Tooth disease, Cholestanol storage disease, Chondrocalcinosis, Chondrodysplasia, Chronic progressive multiple sclerosis, Coenzyme Q10 deficiency, Cohen syndrome, Combined deficiency of factor V and factor VIII, Combined immunodeficiency, Combined oxidative phosphorylation deficiency, Combined partial 1 7-alpha-hydroxylase/17,20-lyase deficiency, Complement factor d deficiency, Complete combined 17-alpha-hydroxylase/17,20-lyase deficiency, Cone-rod dystrophy, Congenital contractural arachnodactyly, Congenital disorder of glycosylation, Congenital lipomatous overgrowth, Neoplasm of ovary, PIK3CA Related Overgrowth Spectrum, Congenital long QT syndrome, Congenital muscular dystrophy, Congenital muscular hypertrophy-cerebral syndrome, Congenital myasthenic syndrome, Congenital myopathy with fiber type di sproportion, Eichsfeld type congenital muscular dystrophy, Congenital stationary night blindness, Corneal dystrophy, Cornelia de Lange syndrome, Craniometaphyseal dysplasia, Crigler Najjar syndrome, Crouzon syndrome, *Cutis laxa* with osteodystrophy, Cyanosis, Cystic fibrosis, Cystinosis, Cytochrome-c oxidase deficiency, Mitochondrial complex 1 deficiency, D-2-hydroxyglutaric aciduria, Danon disease, Deafness with labyrinthine aplasia microtia and microdontia (LAMM), Deafness, Deficiency of acetyl-CoA acetyltransferase, Deficiency of ferroxidase, Deficiency of UDPglucose-hexose-1-phosphate uridylyltransferase, Dejerine-Sottas disease, Desbuquois syndrome, DFNA, Diabetes mellitus type 2, Diabetes-deafness syndrome, Diamond-Blackfan anemia, Diastrophic dysplasia, Dihydropteridine reductase deficiency, Dihydropyrimidinase deficiency, Dilated cardiomyopathy, Disseminated atypical mycobacterial infection, Distal arthrogryposis, Distal hereditary motor neuronopathy, Donnai Barrow syndrome, Duchenne muscular dystrophy, Becker muscular dystrophy, Dyschromatosis universalis hereditaria, Dyskeratosis congenital, Dystonia, Early infantile epileptic encephalopathy, Ehlers-Danlos syndrome, Eichsfeld type congenital muscular dystrophy, Emery-Dreifuss muscular dystrophy, Enamel-renal syndrome, Epidermolysis bullosa dystrophica inversa, Epidermolysis bullosa herpetiformis, Epilepsy, Episodic ataxia, Erythrokeratodermia *variabilis*, Erythropoietic protoporphyria, Exercise intolerance, Exudative vitreoretinopathy, Fabry disease, Factor V deficiency, Factor VII deficiency, Factor xiii deficiency, Familial adenomatous polyposis, breast cancer, ovarian cancer, cold urticaria!, chronic infantile neurological, cutaneous and articular syndrome, hemiplegic migraine, hypercholesterolemia, hypertrophic cardiomyopathy, hypoalphalipoproteinemia, hypokalemia-hypomagnesemia, juvenile gout, hyperlipoproteinemia, visceral amyloidosis, hypophosphatemic vitamin D refractory rickets, FG syndrome, Fibrosis of extraocular muscles, Finnish congenital nephrotic syndrome, focal epilepsy, Focal segmental glomerulosclerosis, Frontonasal dysplasia, Frontotemporal dementia, Fructose-biphosphatase deficiency, Gamstorp-Wohlfart syndrome, Ganglioside sialidase deficiency, GATA-I-related thrombocytopenia, Gaucher disease, Giant axonal neuropathy, Glanzmann thrombasthenia, Glomerulocystic kidney disease, Glomerulopathy, Glucocorticoid resistance, Glucose-6-phosphate transport defect, Glutaric aciduria, Glycogen storage disease, Gorlin syndrome, Holoprosencephaly, GRACILE syndrome, Haemorrhagic telangiectasia, Hemochromatosis, Hemoglobin H disease, Hemolytic anemia, Hemophagocytic lymphohistiocytosis, Carcinoma of colon, Myhre syndrome, leukoencephalopathy, Hereditary factor IX deficiency disease, Hereditary factor VIII deficiency disease, Hereditary factor XI deficiency disease, Hereditary fructosuria, Hereditary Nonpolyposis Colorectal Neoplasm, Hereditary pancreatitis, Hereditary pyropoikilocytosis, Elliptocytosis, Heterotaxy, Heterotopia, Histiocytic medullary reticulosis, Histiocytosis-lymphadenopathy plus syndrome, HNSHA due to aldolase A deficiency, Holocarboxylase synthetase deficiency, Homocysteinemia, Rowel-Evans syndrome, Hydatidiform mole, Hypercalciuric hypercalcemia, Hyperimmunoglobulin D, Mevalonic aciduria, Hyperinsulinemic hypoglycemia, Hyperkalemic Periodic Paralysis, Paramyotonia congenita of von Eulenburg, Hyperlipoproteinemia, Hypermanganesemia, Hypermethioninemia, Hyperphosphatasemia, Hypertension, hypomagnesemia, Hypobetalipoproteinemia, Hypocalcemia, Hypogonadotropic Hypogonadotropic hypogonadism, Hypohidrotic ectodermal dysplasia, Hyper-IgM immunodeficiency, Hypohidrotic X-linked ectodermal dysplasia, Hypomagnesemia, Hypoparathyroidism, Idiopathic fibrosing alveolitis, Immunodeficiency, Immunoglobulin A deficiency, Infantile hypophosphatasia, Infantile Parkinsonism-dystonia, Insulin-dependent diabetes mellitus, Intermediate maple syrup urine disease, Ischiopatellar dysplasia, Islet cell hyperplasia, Isolated growth hormone deficiency, Isolated lutropin deficiency, Isovaleric acidemia, Joubert syndrome, Juvenile polyposis syndrome, Juvenile retinoschisis, Kallmann syndrome, Kartagener syndrome, Kugelberg-W elander disease, Lattice corneal dystrophy, Leber congenital amaurosis, Leber optic atrophy, Left ventricular noncompaction, Leigh disease, Mitochondrial complex I deficiency, Leprechaunism syndrome, Arthrogryposis, Anterior horn cell disease, Leukocyte adhesion deficiency, Leukodystrophy, Leukoencephalopathy, Ovarioleukodystrophy, L-ferritin deficiency, Li-Fraumeni syndrome, Limb-girdle muscular dystrophy-dystroglycanopathy, Loeys-Dietz syndrome, Long QT syndrome, Macrocephaly/autism syndrome, Macular corneal dystrophy, Macular dystrophy, Malignant hyperthermia susceptibility, Malignant tumor of prostate, Maple syrup urine disease, Marden Walker like syndrome, Marfan syndrome, Marie Unna hereditary hypotrichosis, Mast cell disease, Meconium ileus, Medium-chain acyl-coenzyme A dehydrogenase deficiency, Melnick-Fraser syndrome, Mental retardation, Merosin deficient congenital muscular dystrophy, Mesothelioma, Metachromatic leukodystrophy, Metaphyseal chondrodysplasia, Methemoglobinemia, methylmalonic aciduria, homocystinuria, Microcephaly, chorioretinopathy, lymphedema, Microphthalmia, Mild non-PKU hyperphenylalanemia, Mitchell-Riley syndrome, mitochondrial 3-hydroxy-3-methylglutaryl-CoA synthase deficiency, Mitochondrial complex I deficiency, Mitochondrial complex III deficiency, Mitochondrial myopathy, Mucolipidosis III, Mucopolysaccharidosis, Multiple sulfatase deficiency, Myasthenic syndrome, *Mycobacterium tuberculosis*, Myeloperoxidase deficiency, Myhre syndrome, Myoclonic epilepsy, Myofibrillar myopathy, Myoglobinuria, Myopathy, Myopia, Myotonia congenital, Navajo neurohepatopathy, Nemaline myopathy, Neoplasm of stomach, Nephrogenic diabetes insipidus, Nephronophthisis, Nephrotic syndrome, Neurofibromatosis, Neutral lipid storage disease, Niemann-Pick disease, Non-ketotic hyperglycinemia, Noonan syndrome, Noonan syndrome-like disorder, Norum disease, Macular degeneration, N-terminal acetyltransferase deficiency, Oculocutaneous albinism, Oculodentodigital dysplasia, Ohdo syndrome, Optic nerve aplasia, Omithine carbamoyltransferase deficiency, Orofaciodigital syndrome, Osteogenesis imperfecta, Osteopetrosis, Ovarian dysgenesis, Pachyonychia, Palmoplantar keratoderma, nonepidermolytic, Papillon-Lef\xc3\xa8vre syndrome, Haim-Munk syndrome, Periodontitis, Peeling skin syndrome, Pendred syndrome, Peroxisomal fatty acyl-coa reductase I disorder, Peroxisome biogenesis disorder, Pfeiffer syndrome, Phenylketonuria, Phenylketonuria, Hyperphenylalaninemia, non-PKU, Pituitary hormone deficiency, *Pityriasis rubra* pilaris, Polyarteritis nodosa, Polycystic kidney disease, Polycystic lipomembranous osteodysplasia, Polymicrogyria, Pontocerebellar hypoplasia, Porokeratosis, Posterior column ataxia, Primary erythromelalgia, hyperoxaluria, Progressive familial intrahepatic cholestasis, Progressive pseudorheumatoid dysplasia, Propionic acidemia, Pseudohermaphroditism, Pseudohypoaldosteronism, Pseudoxanthoma elasticum-like disorder, Purine-nucleoside phosphorylase deficiency, Pyridoxal 5-phosphate-dependent epilepsy, Renal dysplasia, retinal pigmentary dystrophy, cerebellar ataxia, skeletal dysplasia, Reticular dysgenesis, Retinitis pigmentosa, Usher syndrome, Retinoblastoma, Retinopathy, RRM2B-related mitochondrial disease, Rubinstein-Taybi syndrome, Schnyder crystalline corneal dystrophy, Sebaceous tumor, Severe congenital neutropenia, Severe myoclonic epilepsy in infancy, Severe X-linked myotubular myopathy, onychodysplasia, facial dysmorphism, hypotrichosis, Short-rib thoracic dysplasia, Sialic acid storage disease, Sialidosis, Sideroblastic anemia, Small fiber neuropathy, Smith-Magenis syndrome, Sorsby fundus dystrophy, Spastic ataxia, Spastic paraplegia, Spermatogenic failure, Spherocytosis, Sphingomyelin/cholesterol lipidosis, Spinocerebellar ataxia, Split-hand/foot malformation, Spondyloepimetaphyseal dysplasia, Platyspondylic lethal skeletal dysplasia, Squamous cell carcinoma of the head and neck, Stargardt disease, Sucrase-isomaltase deficiency, Sudden infant death syndrome, Supravalvar aortic stenosis, Surfactant metabolism dysfunction, Tangier disease, Tatton-Brown-rahman syndrome, Thoracic aortic aneurysms and aortic dissections, Thrombophilia, Thyroid hormone resistance, TNF receptor-associated periodic fever syndrome (TRAPS), Tooth agenesis, Torsades de pointes, Transposition of great arteries, Treacher Collins syndrome, Tuberous sclerosis syndrome, Tyrosinase-negative oculocutaneous albinism, Tyrosinase-positive oculocutaneous albinism, Tyrosinemia, UDPglucose-4-epimerase deficiency, Ullrich congenital muscular dystrophy, Bethlem myopathy Usher syndrome, UV-sensitive syndrome, Van der Woude syndrome, popliteal pterygium syndrome, Very long chain acyl-CoA dehydrogenase deficiency, Vesicoureteral reflux, Vitreoretinochoroidopathy, Von Rippel-Lindau syndrome, von Willebrand disease, Waardenburg syndrome, Warsaw breakage syndrome, WFSI-Related Disorders, Wilson disease, Xeroderma pigmentosum, X-linked agammaglobulinemia, X-linked hereditary motor and sensory neuropathy, X-linked severe combined immunodeficiency, and Zellweger syndrome.

In certain embodiments, the methods, systems, and compositions described herein are used to correct one or more pathogenic T(U)-to-C or A-to-G mutations/SNPs as provided in the Table below.

| Candidate | Gene | Disease |
|---|---|---|
| NM_007262.4(PARK7): c.497T>C (p.Leu166Pro) | PARK7 | Parkinson disease 7 |
| NM_174936.3(PCSK9): c.646T>C (p.Phe216Leu) | PCSK9 | Hypercholesterolemia, autosomal dominant, 3 |
| NM_000642.2(AGL): c.3083+2T>C | AGL | Glycogen storage disease type III |
| NM_213653.3(HFE2): c.842T>C (p.Ile281Thr) | HFE2 | Hemochromatosis type 2A |
| NM_170707.3(LMNA): c.799T>C (p.Tyr267His) | LMNA | Primary dilated cardiomyopathy\|not provided |
| NM_000488.3(SERPINC1): c.1141T>C (p.Ser381Pro) | SERPINC1 | Antithrombin III deficiency |
| NM_000465.3(BARD1): c.1159T>C (p.Phe387Leu) | BARD1 | Familial cancer of breast\|not specified\|Hereditary cancer-predisposing syndrome |
| NM_000030.2(AGXT): c.613T>C (p.Ser205Pro) | AGXT | Primary hyperoxaluria, type I\|not provided |
| NM_001302946.1(TRNT1): c.668T>C (p.Ile223Thr) | TRNT1 | Sideroblastic anemia with B-cell immunodeficiency, periodic fevers, and developmental delay |
| NM_138694.3(PKHD1): c.8068T>C (p.Trp2690Arg) | PKHD1 | Autosomal recessive polycystic kidney disease |
| NM_000162.3(GCK): c.1169T>C (p.Ile390Thr) | GCK | Maturity-onset diabetes of the young, type 2 |

-continued

| Candidate | Gene | Disease |
|---|---|---|
| NM_017890.4(VPS13B): c.7504+2T>C | VPS13B | Cohen syndrome |
| NM_000155.3(GALT): c.512T>C (p.Phe171Ser) | GALT | Deficiency of UDPglucose-hexose-1-phosphate uridylyltransferase |
| NM_000277.1(PAH): c.691T>C (p.Ser231Pro) | PAH | Phenylketonuria\|not provided |
| NM_000138.4(FBN1): c.4531T>C (p.Cys1511Arg) | FBN1 | Marfan syndrome |
| NM_000527.4(LDLR): c.1745T>C (p.Leu582Pro) | LDLR | Familial hypercholesterolemia |

Figure 29B:
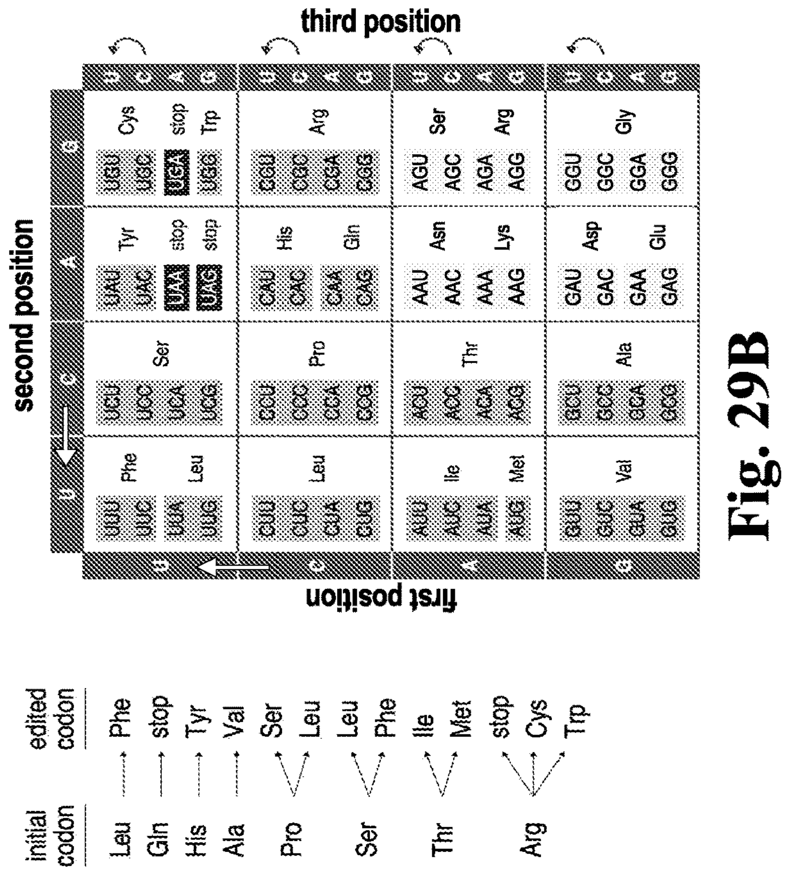
FIG. 29B is a graph showing that RESCUE allows for editing residues associated with PTMs.
Figure 29A:
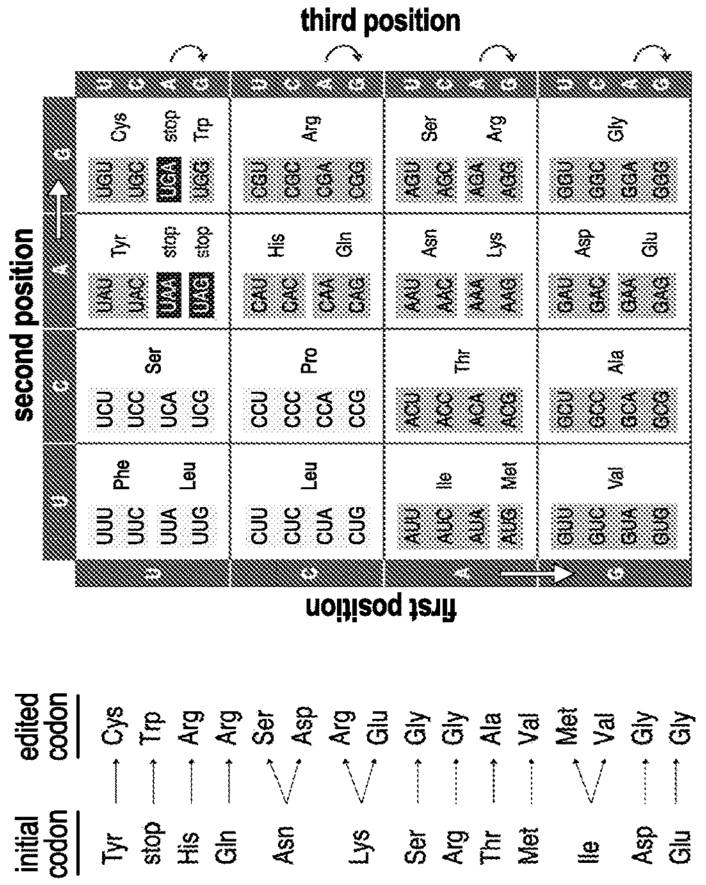
FIG. 29A is a graph showing that REPAIR allows for editing residues associated with PTMs.

Modification of Phosphorylation Sites and Other Post-Translational Modifications The present invention also contemplates use of the CD-functionalized CRISPR system described herein to modify phosphorylation sites and other post-translational modifications (PTMs). The CD-functionalized CRISPR system described herein can edit residues associated with post-translational modifications (FIGS. 29A and 29B). Protein phosphorylations are involved in multiple cellular processes and are relatively easy to target (Humprey et al. Trends Endocrinol Metab 2015, 26(12): 676-687). Current technologies to target phosphorylations sites or other PTMs include whole protein knockdown or knockout, base editing, and small molecule. These methods, however, all have certain drawbacks. Protein target knockdown or knockout will remove whole protein instead of just the PTMs, base editing is permanent, whereas small molecules are also hard to develop and may have unknown targets. Using the CD-functionalized CRISPR system described herein to remove phosphorylations site may allow study of the function of phosphorylations, for example, it can be used for screening kinase targets to determine relative contributions to phenotype, or for transcriptome-wide screening for potential small molecules. Targeting PTMs using CD-functionalized CRISPR system can also have therapeutic potential in cancer, inflammation, metabolism, and differentiation.

In certain embodiments, the AD-functionalized CRISPR system described herein can be used to target Stat3 and/or IRF-5 phosphorylation to reduce inflammation. The target sites can be selected from the group consisting of Stat3 Tyr705, IRF-5 Thr10, Ser158, Ser309, Ser317, Ser451 and Ser462, all of which are involved in interleukin signaling and/or autoimmunity (Sadreev et al. PLOS One 2014, 9(10): e110913). Accordingly, an additional aspect of the invention relates to a method for treating or preventing autoimmune disease by targeting the aforementioned phosphorylation sites.

In certain embodiments, the CD-functionalized CRISPR system described herein can be used to target Insulin receptor substrate (IRS) phosphorylation. The target sites can be selected from the group consisting of Ser-265, Ser-302, Ser-325, Ser-336, Ser-358, Ser-407, and Ser-408 of IRS-1. The phosphorylation of these sites reduces insulin sensitivity (Copps and White Diabetologia 2012 October; 55(10): 2565-2582), and reducing inhibitory serine phosphorylation at these sites can rescue insulin sensitivity. Accordingly, an additional aspect of the invention relates to a method for treating or preventing diabetes by targeting the aforementioned phosphorylation sites.

Making Hypomorphic Mutations

In certain embodiments, the CD-functionalized CRISPR system described herein can be used to make hypomorphic mutations. Engineering hypomorphic mutations can lead to significant downregulation of essential genes without lethality, which allows for straightforward creation of models for diseases that involve hypomorphic mutations and decreasing levels of certain proteins in a fine-tuned manner for therapeutic applications. PolyA track insertion is an existing technology to create hypomorphic mutants. Using the CD-functionalized CRISPR system for introducing hypomorphic mutations is minimally disruptive, precise, and can be fine-tuned.

In certain embodiments, the CD-functionalized CRISPR system can be used for targeted editing of immune checkpoint proteins. Immune checkpoint blockade is used in cancer therapy to enhance anti-tumor immunity by promoting T-cell activation and proliferation, which includes anti-CTLA4 and anti-PD-1 therapies (Byun et al., Nat Reviews Endocrinology 2017). Using the CD-functionalized CRISPR system can improve efficacy over existing CTLA-4, PD-1/PD-L1 inhibitor therapies. The AD-functionalized CRISPR system can also be employed to inhibit other suppressive immune checkpoints (such as TIM-3, KIRs, and LAG-3) and to introduce hypomorphic mutations to immune activating checkpoints such as 4-IBB and GITR. In particular embodiments, the CD-functionalized CRISPR system can be used for targeted editing of CTLA-4/B7-1 interaction surface 99MYPPPY104 stem loop (Stamper et. al., Nature 2001 March 29; 410(6828): 608-11), for example, the C-to-U editing can convert proline to serine or leucine. In particular embodiments, the CD-functionalized CRISPR system can be used for targeted editing of CTLA-4/B7-2 interface at E33, $R^{35}$, T53, and E97 (Schwartz et. al., Nature 2001 March 29; 410(6828): 604-8; Peach et. al., Cell (1994)), for example, the C-to-U editing can convert arginine to cysteine, stop codon, or tryptophan. Accordingly, an additional aspect of the invention relates to a method for treating or preventing cancer by editing the aforementioned residues involved in immune checkpoint protein interactions.

Modulating Protein Stability

In certain embodiments, the CD-functionalized CRISPR system described herein can be used to modulate protein stability. In particular embodiments, the CD-functionalized CRISPR system can be used for general degron targeting. A degron is a portion of a protein that is important in regulation of protein degradation rates. Known degrons include short amino acid sequences, structural motifs and exposed amino acids (often Lysine or Arginine) located anywhere in the protein. Some proteins can contain multiple degrons. While there are many types of different degrons, and a high degree of variability even within these groups, degrons are all similar for their involvement in regulating the rate of a protein degradation and can be categorized as “Ubiquitin-dependent” or “Ubiquitin-independent”.

In certain example embodiments, the CD-functionalized CRISPR system can be used for targeted editing of the degron present in SMN2, a protein involved in spinal muscular atrophy (SMA). SMA is caused by homozygous survival of motor neurons 1 (SMN1) gene deletions, leaving a duplicate gene, SMN2, as the sole source of SMN protein. SMA disease severity correlates to the amount of functional protein. For example, severe SMA (type I) patients typically have one or two SMN2 copies, intermediate severity SMA (type II) patients usually have three SMN2 copies, and patients with mild SMA (type III) mostly have three or four SMN2 copies. Most of the mRNA produced from SMN2 pre-mRNA is exon 7-skipped (about 80%), resulting in a highly unstable and almost undetectable protein (SMN-Delta7). This splicing defect creates a degradation signal (degron; SMNDelta7-DEG) at SMNDelta7’s C-terminal 15 amino acids. The S270A mutation inactivates SMNDelta7-DEG, generating a stable SMNDelta7 that rescues viability of SMN-deleted cells. (Cho and Dreyfuss, Genes and Dev., 2010 March 1; 24(5): 438-42). The CD-functionalized CRISPR system can be used for targeted editing of S270, thereby disrupts the degron present in SMN2. Accordingly, an additional aspect of the invention relates to a method for treating or preventing SMA by editing the aforementioned residues involved in regulating SMN stability.

In certain embodiments, the CD-functionalized CRISPR system can be used for disrupting the D-box degrons, resulting in the conversion of Leu to The. In other embodiments, the CD-functionalized CRISPR system can be used for disrupting the KEN-box degrons, resulting in the conversion of Lys to Arg/Glu, Glu to Gly, or Asn to Ser/Asp.

The N-degrons were first characterized in yeast to the PEST sequence of mouse ornithine decarboxylase. A PEST sequence is a peptide sequence that is rich in proline (P), glutamic acid (E), serine(S), and threonine (T). This sequence is associated with proteins that have a short intracellular half-life; hence, it is hypothesized that the PEST sequence acts as a signal peptide for protein degradation. The CD-functionalized CRISPR system can be used for targeted editing of the PEST sequence, hence regulating protein stability. In particular example embodiments, the AD-functionalized CRISPR system can be used for targeting the PEST sequence or a regulated, ubiquitin-independent degron in IκBα (Fortmann et al, JMB Molecular Bio 2015 August 28; 427(17): 2748-2756). In particular embodiments, the AD-functionalized CRISPR system can be used for editing a PEST sequence in NANOG to promote embryonic stem cell (ESC) pluripotency. In particular embodiments, the CD-functionalized CRISPR system can be used for editing a PEST sequence in Cdc25A phosphatase. In other embodiments, the CD-functionalized CRISPR system can also be employed to facilitate protein degradation, for example, by mutating the residues to enhance the degree of degradation or by mutating the N-terminal methionine.

Targeting Ion Channels for Therapy

In certain embodiments, the CD-functionalized CRISPR system described herein can be used to target ion channels. Ions regulate many physiological processes, including heart contractility, nervous system signal transduction, and control of pulmonary vasculature pressure. Small molecules that affect ion channels, such as Digoxin and Lidocaine are widely used in clinical medicine. These small molecules, however, have toxicity issues and only act on shorter time scales whereas the diseases being treated such as heart failure or arrhythmias, are often chronic. Knockdown approach is also not desirable as it may affect other biological roles played by the ion channels.

In certain embodiments, the CD-functionalized CRISPR system can be used to make stop codons to block ion channels. In certain embodiments, the AD-functionalized CRISPR system can be used to make stop codons to skip exons. The ion channels can be sodium or potassium ion channels. In particular embodiments, the CD-functionalized CRISPR system can be used to make mutations selected from the group consisting of V36I, F216S, S241T, R277X, Y328X, N395K, S459X, E693X, I767X, R830X, 1848T, L858H, L858H, L858F, A863P, W897X, R996C, F1200LfsX33, I1235LfsX2, V1298F, V1298D, V1299F, F1449V, c.4336-7_10delGTTTX, I1461T, F1462V, T1464I, R1488X, M1267K, K1659X, W1689X in the sodium-channel subunit Nav1.7 (Drenth and Waxman, J C I, 2007 December; 117(12): 3603-9). In certain embodiments, the CD-functionalized CRISPR system can be used to edit RNA in neurons. The resulting ion channel activity change can be assessed via patch-clamping and pain sensitivity can be examined using existing mouse models (Gao et al., J Neurosci. 2009 Apr. 1; 29(13): 4096-108). Accordingly, an additional aspect of the invention relates to a method for treating or preventing heart failure or arrhythmia by editing the aforementioned residues involved in ion channel activities.

TGFbeta Modulation to Prevent Cardiac Remodeling

In certain embodiments, the CD-functionalized CRISPR system can be used to modulate TGFbeta signaling to prevent cardiac remodeling. After myocardial infarction, TGFbeta signaling promotes cardiac fibrosis and cardiomyocyte apoptosis and blocks the inflammatory response that can heal the cardiac tissue. Therefore negative heart remodeling can be prevented by blocking TGFbeta signaling. The type II TGFbeta receptor requires autophosphorylation at Ser213 and Ser409 as well as Thr259, 336, and 424 for activity. The CD-functionalized CRISPR system can be used to mutate the serines to Leu or Phe, or tyrosines to Cys, which can prevent autophosphorylation and TGFbeta activation in fibroblasts and cardiomyocytes.

In certain embodiments, the CD-functionalized CRISPR system can be used to mutate the Smad transcription factors downstream of the TGFbeta receptor to prevent their activation via phosphorylation. The CD-functionalized CRISPR system can mutate the phosphorylation sites selected from the group consisting of Thr8, Thr179, Ser208, and Ser213 of Smad3 and Ser245, Ser250, Ser255, and Thr8 of Smad2. The CD-functionalized CRISPR system can be used to mutate the serines to Leu or Phe, or threonines to Ile or Met. Accordingly, an additional aspect of the invention relates to a method for preventing cardiac remodeling by editing the aforementioned residues involved in TGFbeta signaling.

Other Applications

In certain embodiments, the CD-functionalized CRISPR system can be used in lineage tracing. In certain embodiments, the CD-functionalized CRISPR system can be used for sensing with REPAIR system. Different orthologs can be induced and editing can be focused on synthetic transcripts. In certain embodiments, the CD-functionalized CRISPR system can be used for saturation mutagenesis on specific proteins to identify functional domains. In certain embodiments, the CD-functionalized CRISPR system can be used to identify RNA binding protein interactions. The CD-functionalized CRISPR system can be used to map protein-protein binding interfaces. Saturation mutagenesis on be performed on one protein followed by FRET and cell sorting to determine which guide RNA disrupts protein-protein interactions.

In certain embodiments, the CD-functionalized CRISPR system can be used for transient inactivation or activation of proteins, generating heterozygous protective mutations, pre or pro-protein cleavage sites, generation of neoantigens, creating conditional fusion proteins, editing of poly-A signals, RNA targeting to introduce other epitranscriptomic modifications, for identification or modification of RNA binding protein sites, mapping RNA-RNA contacts, or editing co-localized RNPs.

In some embodiments, the CD-functionalized CRISPR system can be used for modification ubiquitination or acetylation sites, tissue regeneration, cell differentiation, creating motifs recognized by ubiquitin ligases, single cell barcoding, creating splice sites, or altering antigen receptors.

The embodiments, illustratively described herein may suitably be practiced in the absence of any element or elements, limitation or limitations, not specifically disclosed herein. Thus, for example, the terms "comprising," "including," "containing," etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the claimed technology. Additionally, the phrase "consisting essentially of" will be understood to include those elements specifically recited and those additional elements that do not materially affect the basic and novel characteristics of the claimed technology. The phrase "consisting of" excludes any element not specified.

The present disclosure is not to be limited in terms of the particular embodiments described in this application. Many modifications and variations can be made without departing from its spirit and scope, as will be apparent to those skilled in the art. Functionally equivalent methods and compositions within the scope of the disclosure, in addition to those enumerated herein, will be apparent to those skilled in the art from the foregoing descriptions. Such modifications and variations are intended to fall within the scope of the appended claims. The present disclosure is to be limited only by the terms of the appended claims, along with the full scope of equivalents to which such claims are entitled. It is to be understood that this disclosure is not limited to particular methods, reagents, compounds compositions or biological systems, which can of course vary. It is also to be understood that the terminology used herein is for the purpose of describing particular embodiments only, and is not intended to be limiting.

Additional pathogenic C>T mutations and SNPs are also found in the ClinVar database. Accordingly, an additional aspect of the present disclosure relates to correction of a pathogenic C>T mutation or SNP listed in ClinVar using the methods, systems, and compositions described herein to treat or prevent a disease or condition associated therewith. Other T mutations or SNPS that may be addressed using the embodiments disclosed herein are listed in a table found in the ASCII text filed entitled "Clin_var_pathogenic_SNPS_TC_txt" filed herewith.

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, particularly in terms of providing a written description, all ranges disclosed herein also encompass any and all possible subranges and combinations of subranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like, include the number recited and refer to ranges which can be subsequently broken down into subranges as discussed above. Finally, as will be understood by one skilled in the art, a range includes each individual member.

All publications, patent applications, issued patents, and other documents referred to in this specification are herein incorporated by reference as if each individual publication, patent application, issued patent, or other document was specifically and individually indicated to be incorporated by reference in its entirety. Definitions that are contained in text incorporated by reference are excluded to the extent that they contradict definitions in this disclosure.

Other embodiments are set forth in the following claims.

WORKING EXAMPLES

Example 1

To test Cas13-guided cytosine deaminase editing, multiple C-terminal fusions of various cytosine deaminases from human and related species were designed (https://www.ncbi.nlm.nih.gov/pubmed/21568845, Lada et al. (2011), Biochemistry (Mosc.), 76(1): 131-46), see also the Table below. To initially test for activity, reactivation of a start codon in Crypidina luciferase is tested (FIG. 1A).

APOBEC designs

| Name | Gene | Species | Protein sequence |
|---|---|---|---|
| Apobec-3A (SEQ ID NO: 195) | huABC3A | human | MEASPASGPRHLMDPHIFTSNFNNGIGRHKTYLC YEVERLDNGTSVKMDQHRGFLHNQAKNLLCGFYG RHAELRFLDLVPSLQLDPAQIYRVTWFISWSPCF SWGCAGEVRAFLQENTHVRLRIFAARIYDYDPLY KEALQMLRDAGAQVSIMTYDEFKHCWDTFVDHQG CPFQPWDGLDEHSQALSGRLRAILQNQGN |
| Apobec-3G (SEQ ID NO: 196) | huABC3G | human | MKPHFRNTVERMYRDTFSYNFYNRPILSRRNTVW LCYEVKTKGPSRPPLDAKIFRGQVYSELKYHPEM RFFHWFSKWRKLHRDQEYEVTWYISWSPCTKCTR DMATFLAEDPKVTLTIFVARLYYFWDPDYQEALR SLCQKRDGPRATMKIMNYDEFQHCWSKFVYSQRE LFEPWNNLPKYYILLHIMLGEILRHSMDPPTFTF NFNNEPWVRGRHETYLCYEVERMHNDTWVLLNQR RGFLCNQAPHKHGFLEGRHAELCFLDVIPFWKLD LDQDYRVTCFTSWSPCFSCAQEMAKFISKNKHVS LCIFTARIYDDQGRCQEGLRTLAEAGAKISIMTY SEFKHCWDTFVDHQGCPFQPWDGLDEHSQDLSGR LRAILQNQEN |
| Apobec1 (SEQ ID NO: 197) | huABEC1 | human | MTSEKGPSTGDPTLRRRIEPWEFDVFYDPRELRK EACLLYEIKWGMSRKIWRSSGKNTTNHVEVNFIK KFTSERDFHPSMSCSITWFLSWSPCWECSQAIRE FLSRHPGVTLVIYVARLFWHMDQQNRQGLRDLVN SGVTIQIMRASEYYHCWRNFVNYPPGDEAHWPQY PPLWMMLYALELHCIILSLPPCLKISRRWQNHLT FFRLHLQNCHYQTIPPHILLATGLIHPSVAWR |
| AID (SEQ ID NO: 198) | huAICDA | human | MDSLLMNRRKFLYQFKNVRWAKGRRETYLCYVVK RRDSATSFSLDFGYLRNKNGCHVELLFLRYISDW DLDPGRCYRVTWFTSWSPCYDCARHVADFLRGNP NLSLRIFTARLYFCEDRKAEPEGLRRLHRAGVQI AIMTFKDYFYCWNTFVENHERTFKAWEGLHENSV RLSRQLRRILLPLYEVDDLRDAFRTLGL |
| ABEC1 (SEQ ID NO: 199) | mABEC1 | mouse | MSSETGPVAVDPTLRRRIEPHEFEVFFDPRELRK ETCLLYEINWGGRHSVWRHTSQNTSNHVEVNFLE KFTTERYFRPNTRCSITWFLSWSPCGECSRAITE FLSRHPYVTLFIYIARLYHHTDQRNRQGLRDLIS SGVTIQIMTEQEYCYCWRNFVNYPPSNEAYWPRY PHLWVKLYVLELYCIILGLPPCLKILRRKQPQLT FFTITLQTCHYQRIPPHLLWATGLK |
| ABEC1 (SEQ ID NO: 200) | rABEC1 | rat | MSSETGPVAVDPTLRRRIEPHEFEVFFDPRELRK ETCLLYEINWGGRHSIWRHTSQNTNKHVEVNFIE KFTTERYFCPNTRCSITWFLSWSPCGECSRAITE FLSRYPHVTLFIYIARLYHHADPRNRQGLRDLIS SGVTIQIMTEQESGYCWRNFVNYSPSNEAHWPRY PHLWVRLYVLELYCIILGLPPCLNILRRKQPQLT FFTIALQSCHYQRLPPHILWATGLK |

Eleven (11) guides were designed (FIG. 1B): 5 guides positioned 5' to the edit, 5 guides positioned 3' to the edit, and an overlapping guide. Upon successful editing, the threonine (encoded by ACG) will be converted to a methionine/start (encoded by AUG) allowing for expression.

Figure 5:
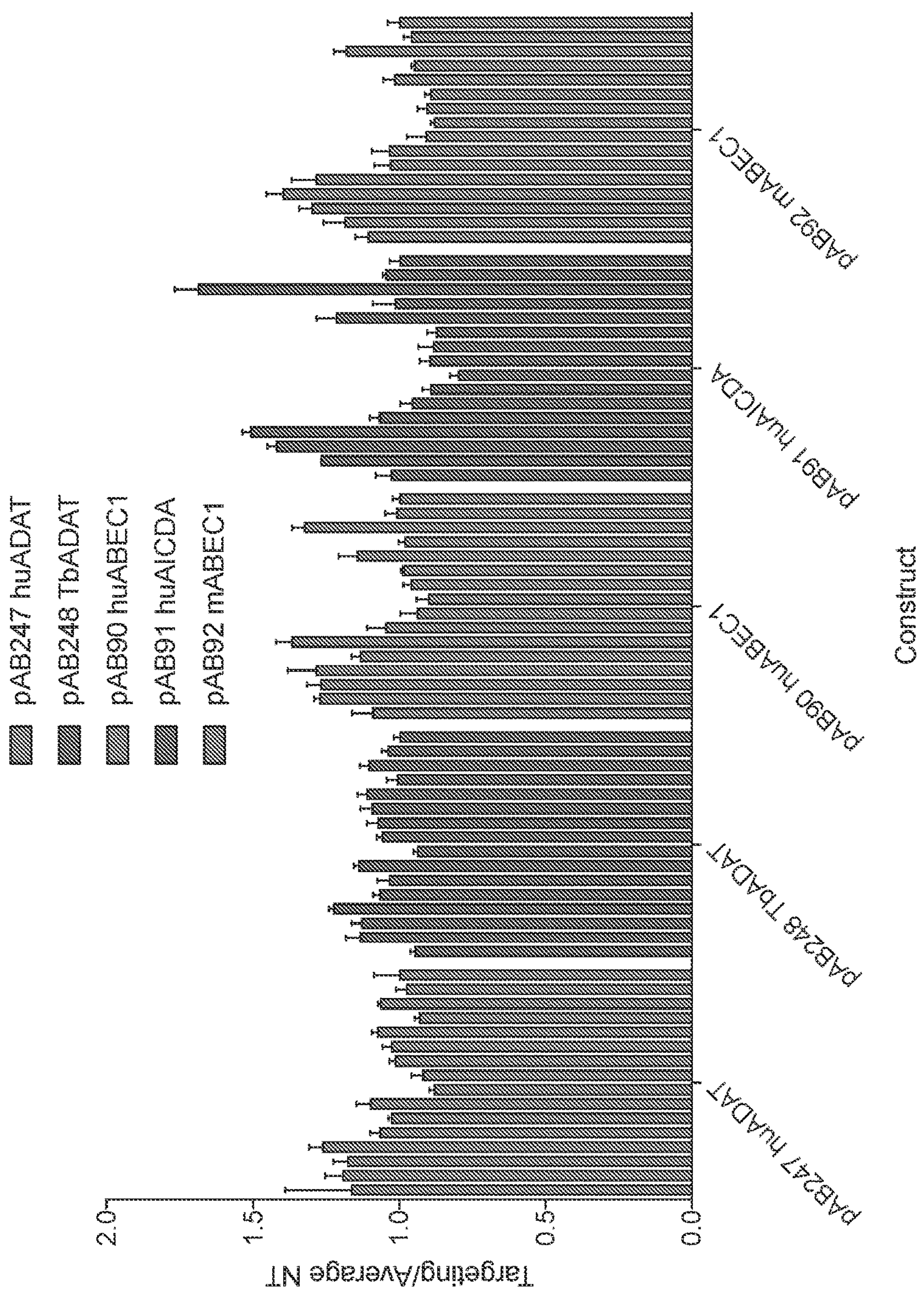
FIG. 5: Provides results of an assay assessing guide design and cytidine deaminase function.
Figure 6:
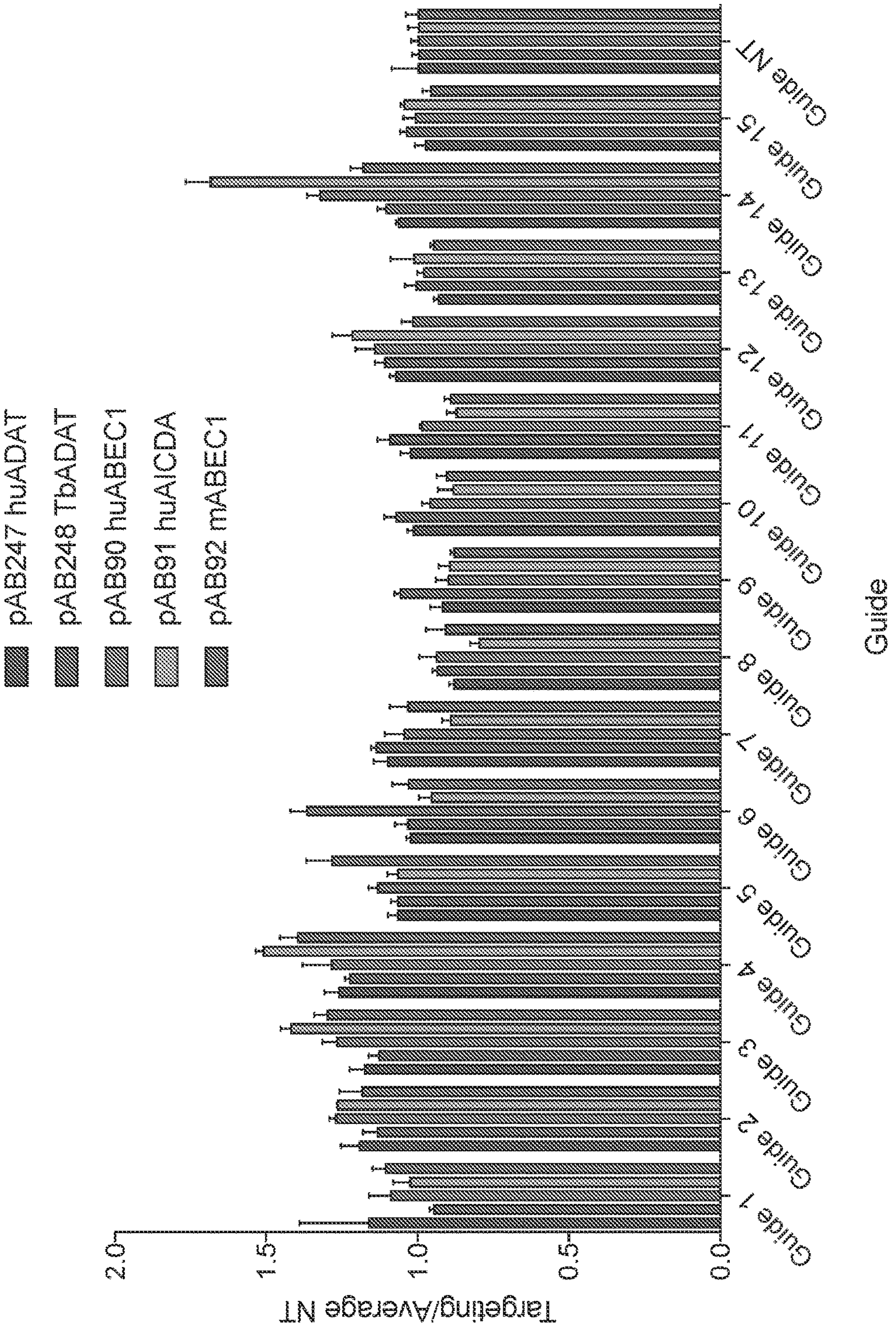
FIG. 6: Provides results of guide sequence designs on deaminase activity with multiple Cas13b-cytidine deaminase fusion constructs, in accordance with certain example embodiments.
Figure 7:
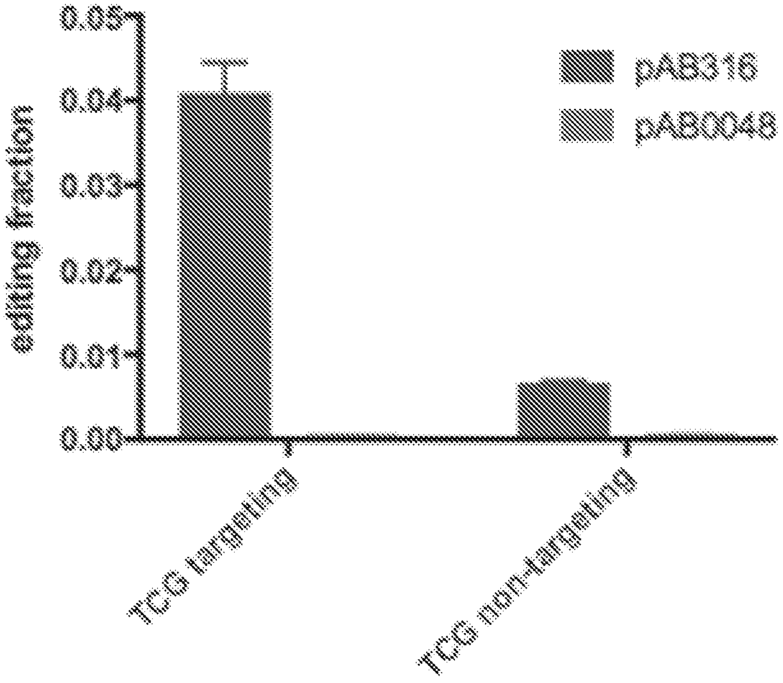
FIG. 7 is a graph showing that V351G editing greatly increases REPAIR editing. The V351G mutation (pAB316) was introduced into the E488Q PspCas13b (Cas13b12) REPAIR construct (REPAIR v1, pAB0048) and tested for C-U activity on a gauss luciferase construct with a TCG motif (TCG). Editing was read out by next generation sequencing, revealing increased C-U activity.
Figure 8:
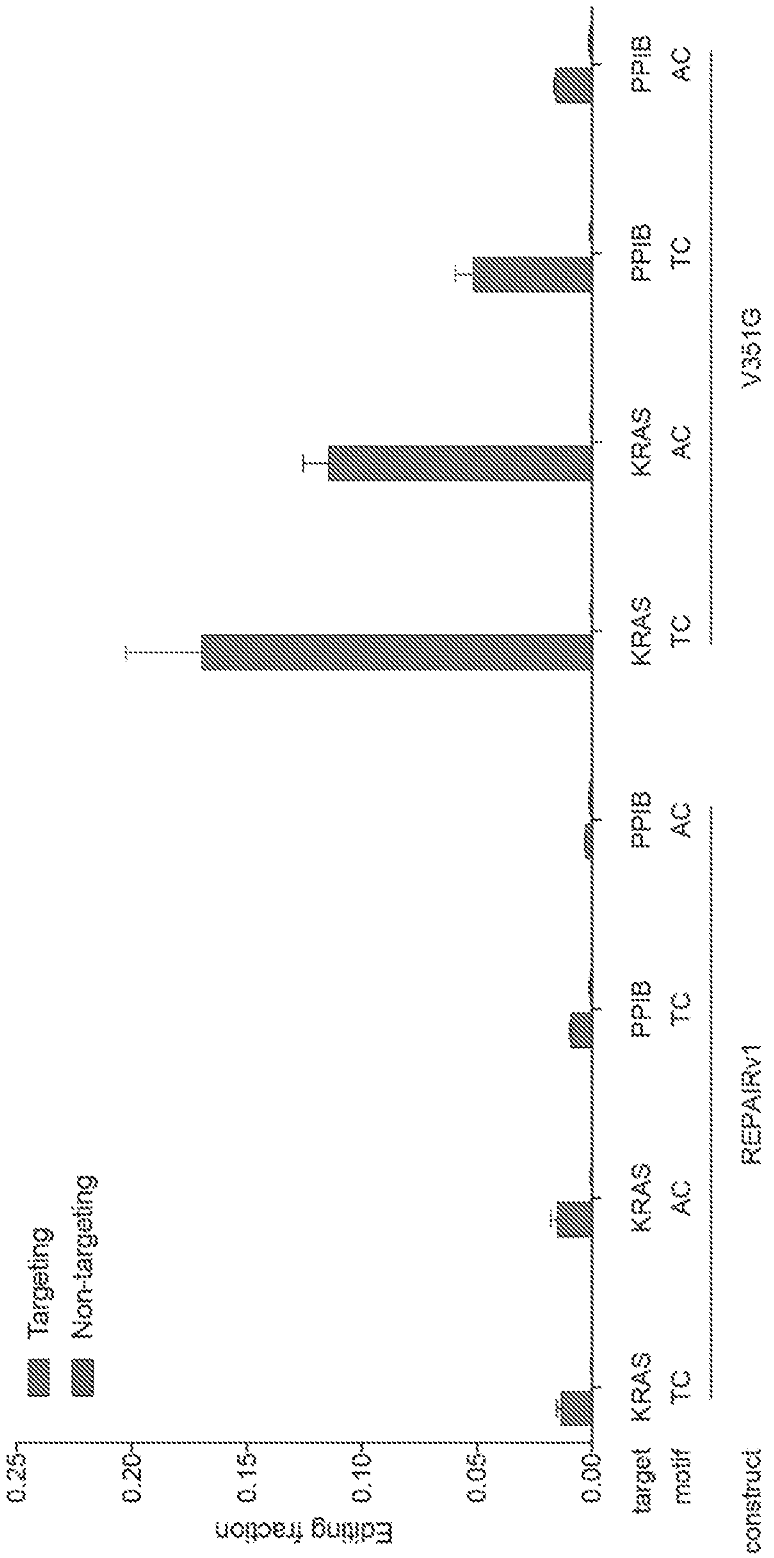
FIG. 8 is a graph showing endogenous KRAS and PPIB targeting. The V351G mutation (pAB316) was introduced into the E488Q PspCas13b REPAIR construct (REPAIR v1, pAB0048) and tested for C-U activity on a gauss four sites, two in each gene, with different motifs. Editing was read out by next generation sequencing, revealing increased C-U activity.
Figure 9:
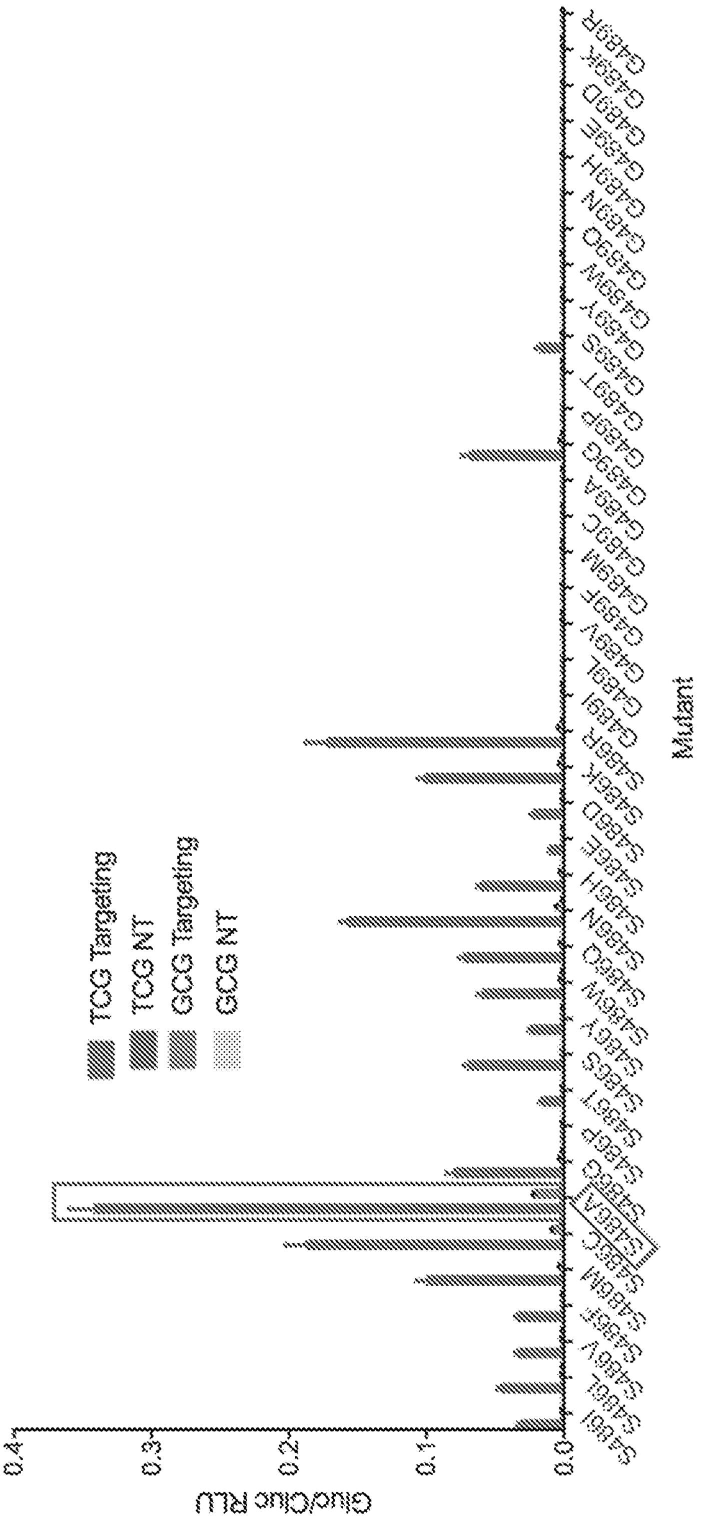
FIG. 9 is a graph showing optimal V351G combination mutants. Selected sites (S486, G489) were mutagenized to all 20 possible residues and tested on a background of REPAIR [E488Q, V351G]. Constructs were tested on two luciferase motifs, TCG and GCG, and selected on the basis of luciferase activity.
Figure 10:
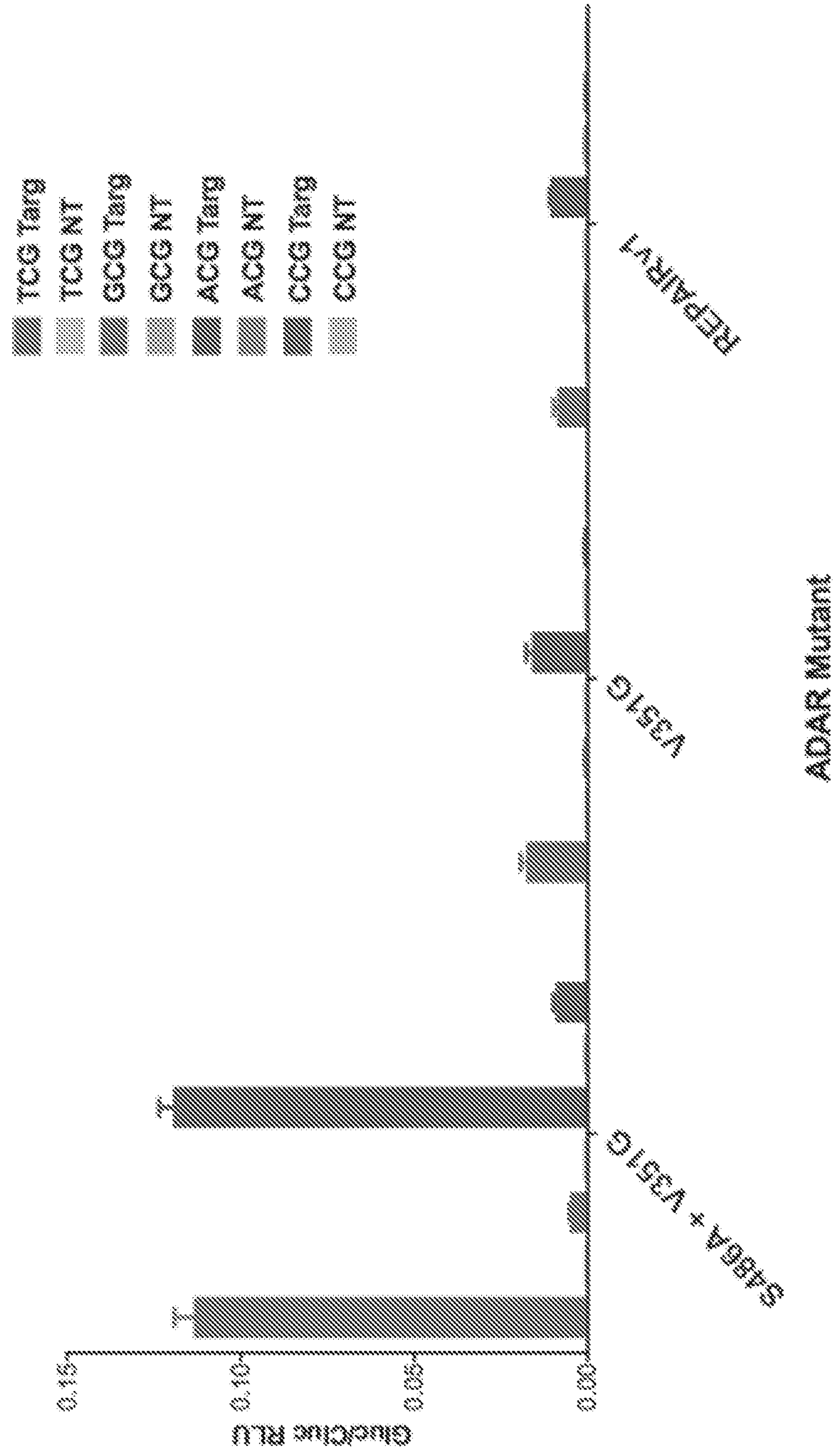
FIG. 10 is a graph showing S486A and V351G combination C-to-U activity. S486A was tested against the [V351G, E488Q] background and the E488Q background on all four motifs, with luciferase activity as a readout. S486A performs better on all motifs, especially ACG and TCG.
Figure 11:
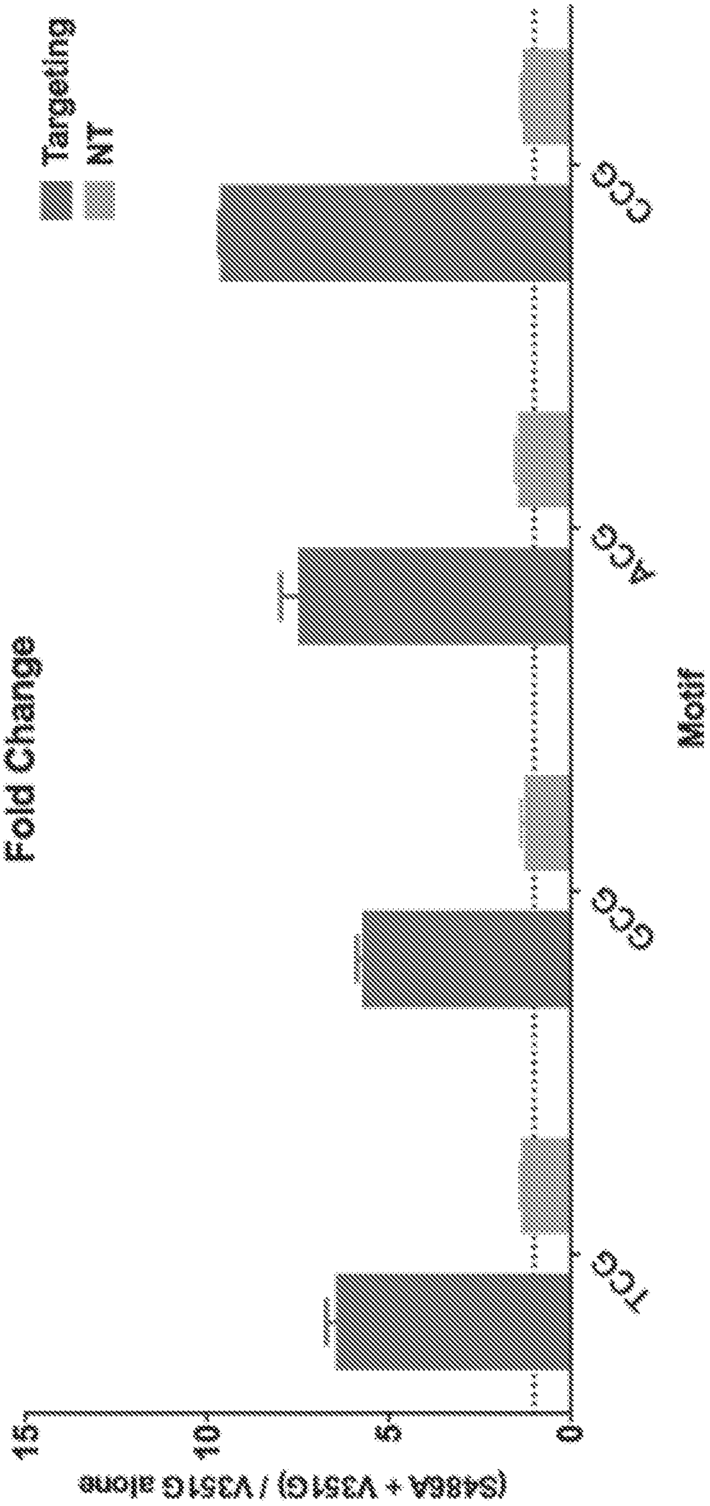
FIG. 11 is a graph showing that S486A improves C-to-U editing across all motifs. S486A improves targeting over the [V351G, E488Q] background on all motifs, when measured by luciferase activity.
Figure 12A:
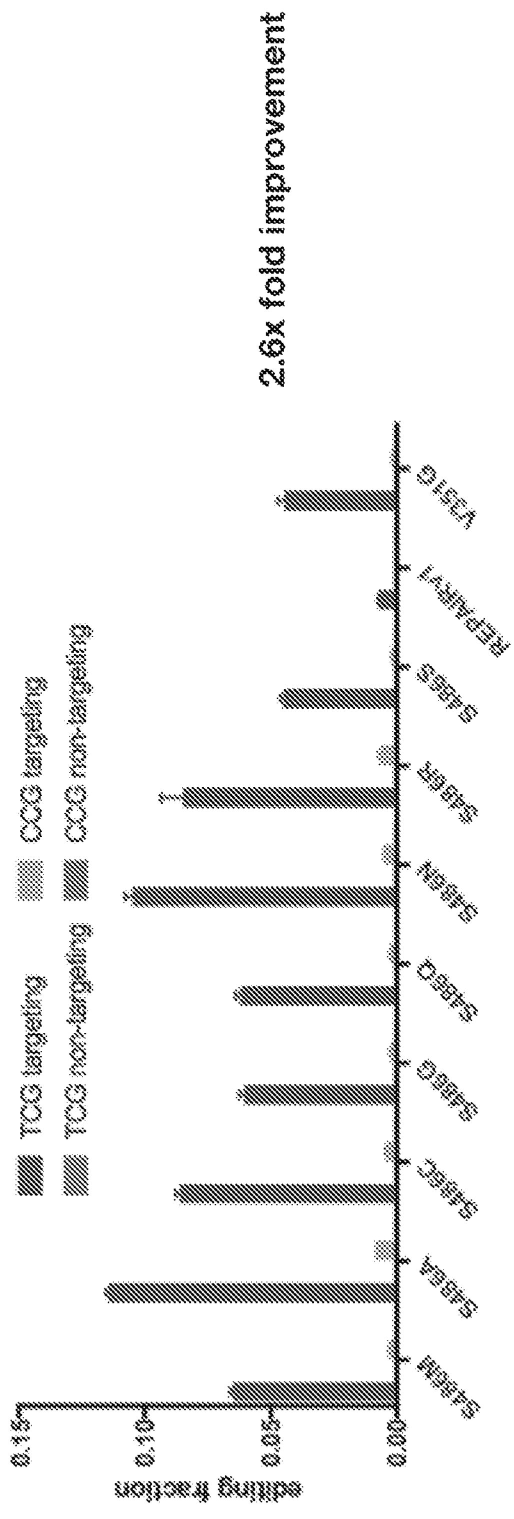
FIG. 12A is a graph showing S486 mutants C-to-U activity with both TCG and CCG targeting.
Figure 12B:
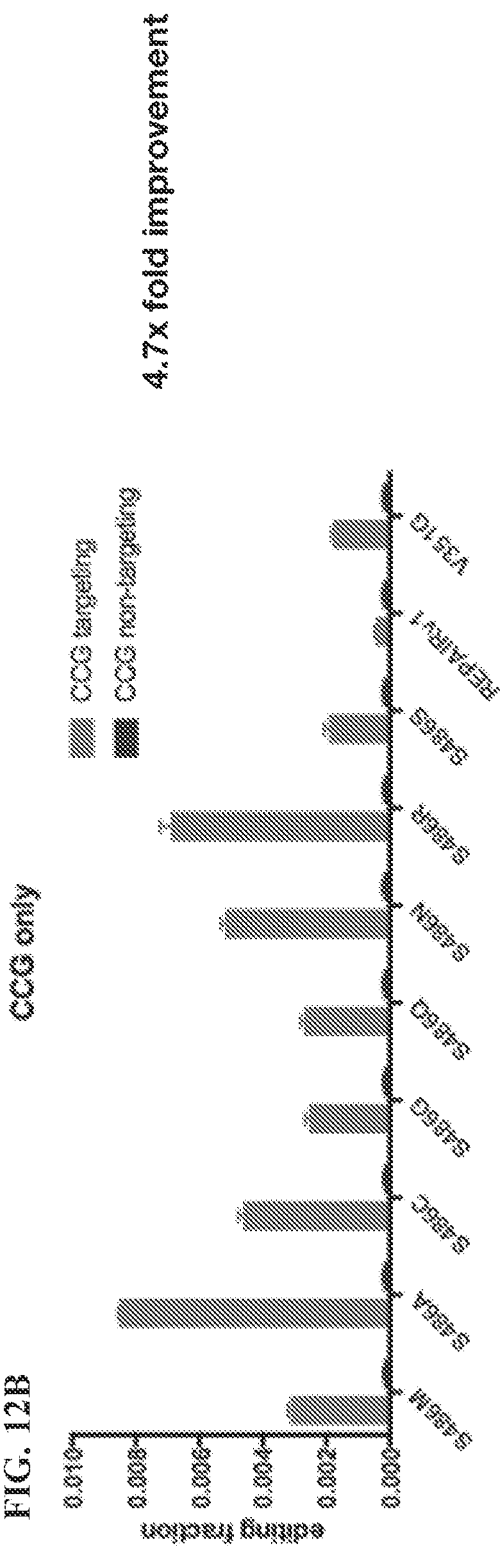
FIG. 12B is a graph showing S486 mutants C-to-U activity with CCG targeting only. S486A was tested against the [V351G, E488Q] background and the E488Q background on all four motifs, with NGS as a readout. S486A performs better on all motifs, especially ACG and TCG.
Figure 13:
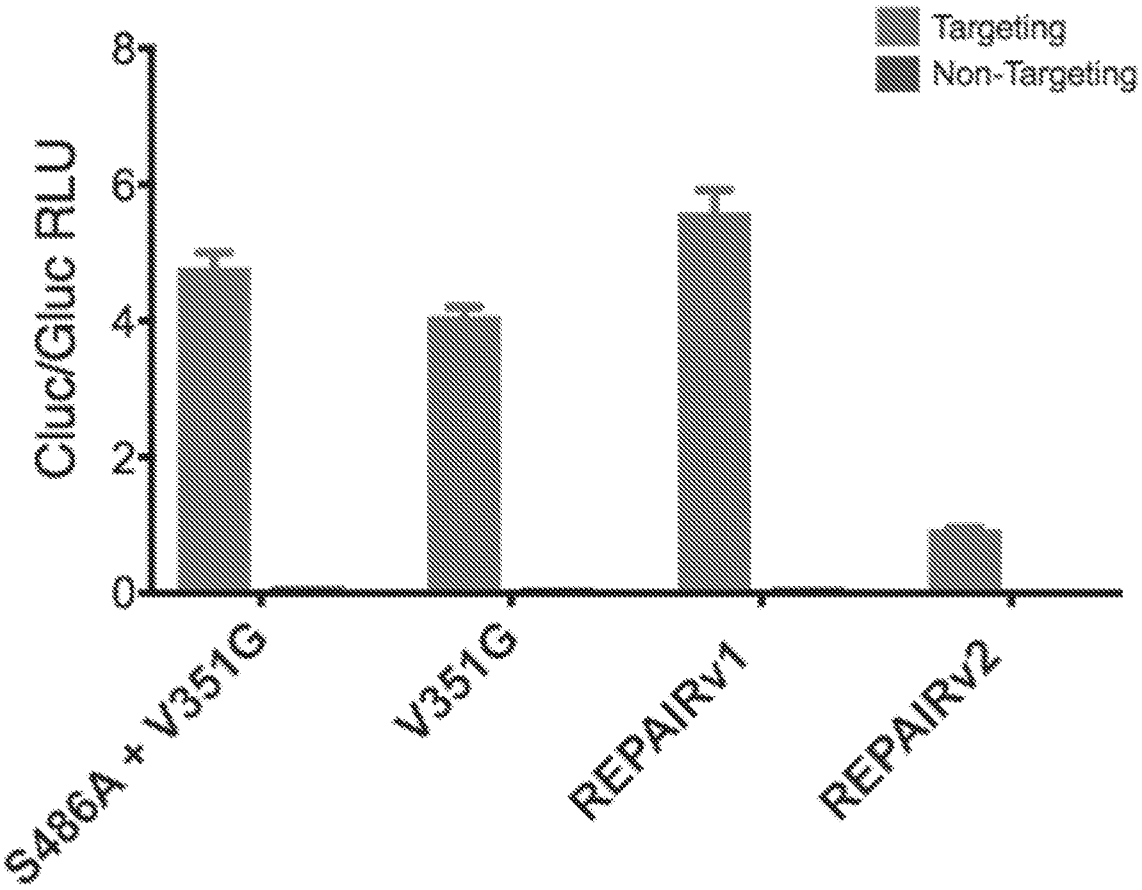
FIG. 13 is a graph showing S486A A-to-I activity. The data shows that S486A mutations maintain A-to-I activity of the previous constructs when measured on a luciferase reporter.
Figure 14:
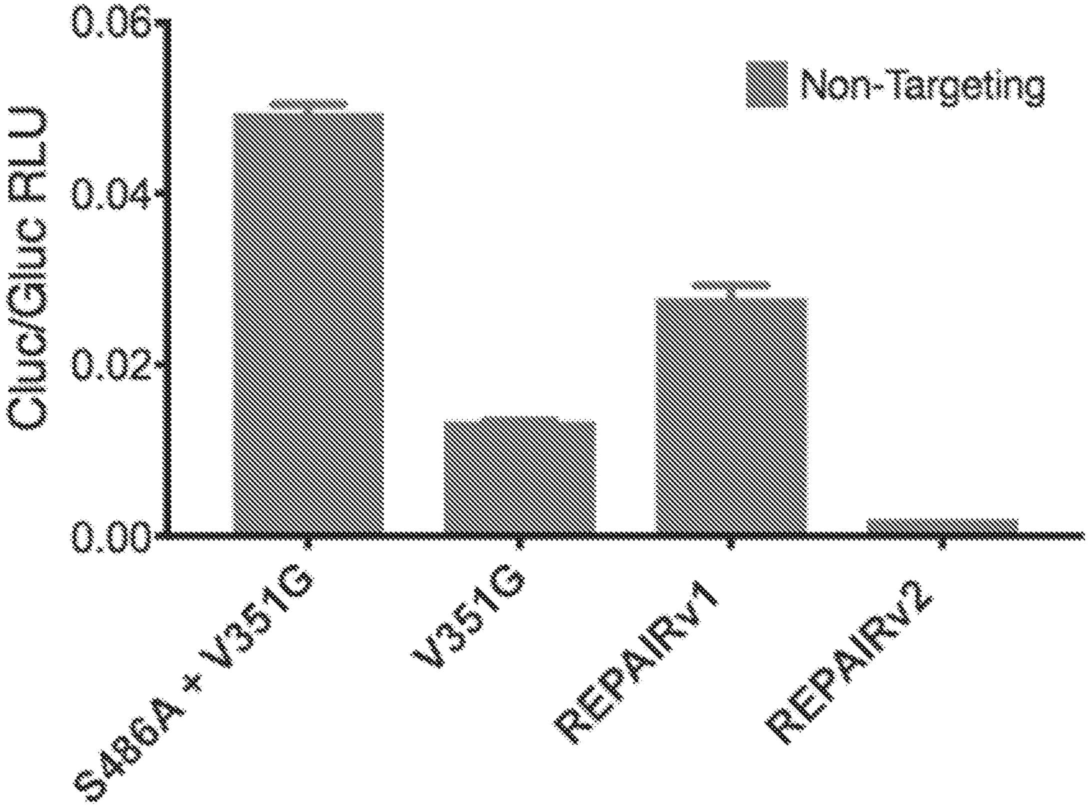
FIG. 14 is a graph showing S486A A-to-I off-target activity. The data shows that S486A has comparable A-to-I off-target activity when measured on a luciferase reporter.
Figure 15B:
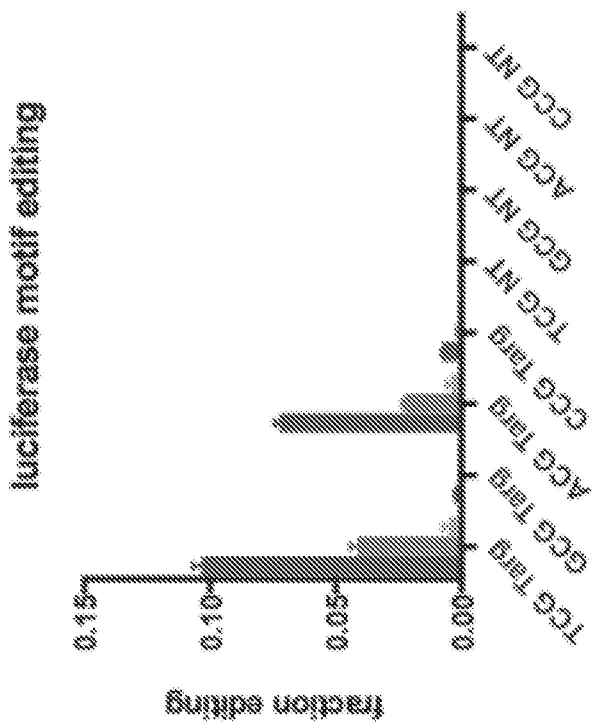
FIG. 15B is a graph showing that targeting by S486A/V351G/E488Q (pAB493), V351G/E488Q (pAB316), and E488Q (REPAIRv1) is comparable when assayed by NGS (fraction editing).
Figure 15A:
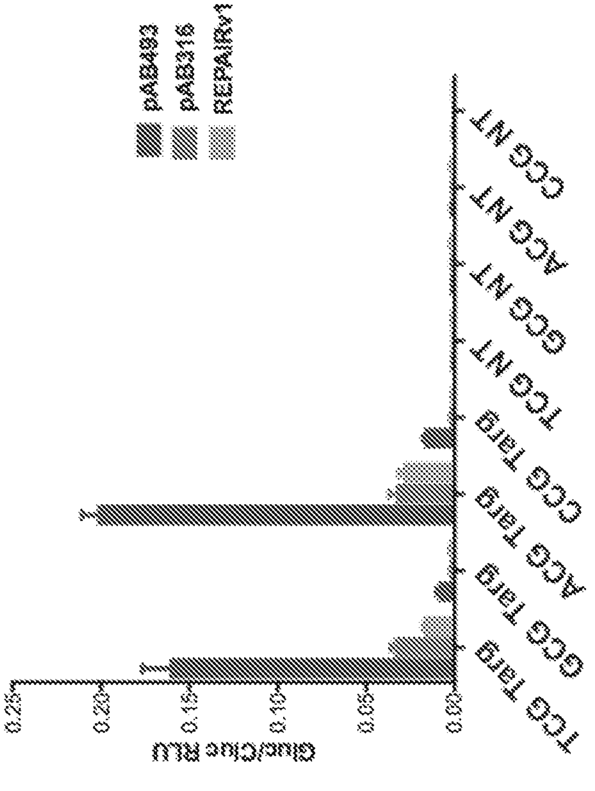
FIG. 15A is a graph showing that targeting by S486A/V351G/E488Q (pAB493), V351G/E488Q (pAB316), and E488Q (REPAIRv1) is comparable when read out by luciferase activity (Gluc/Cluc RLU).
Figure 16B:
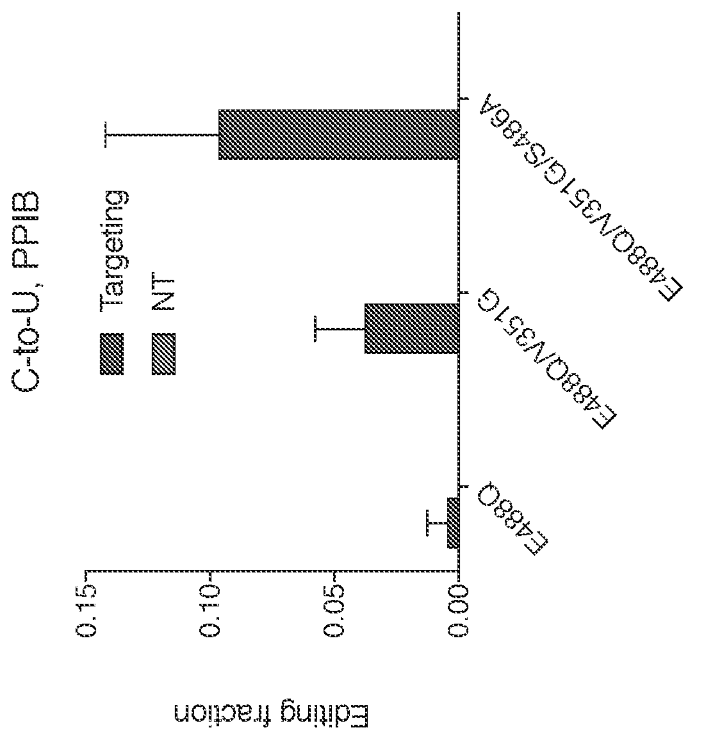
FIG. 16B is a graph showing S486A C-to-U activity by NGS on endogenous gene PPIB.
Figure 16A:
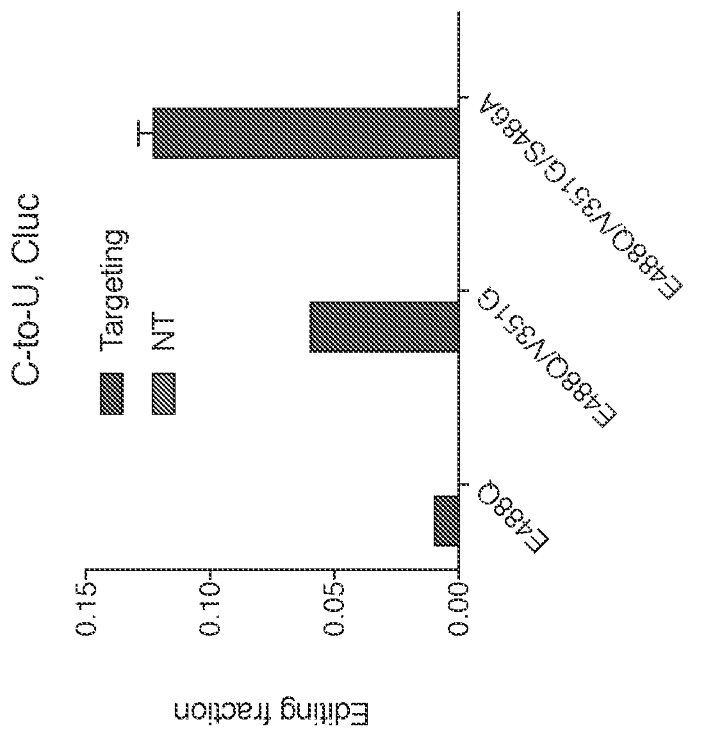
FIG. 16A is a graph showing S486A C-to-U activity by NGS on Cluc reporter constructs.
Figure 17:
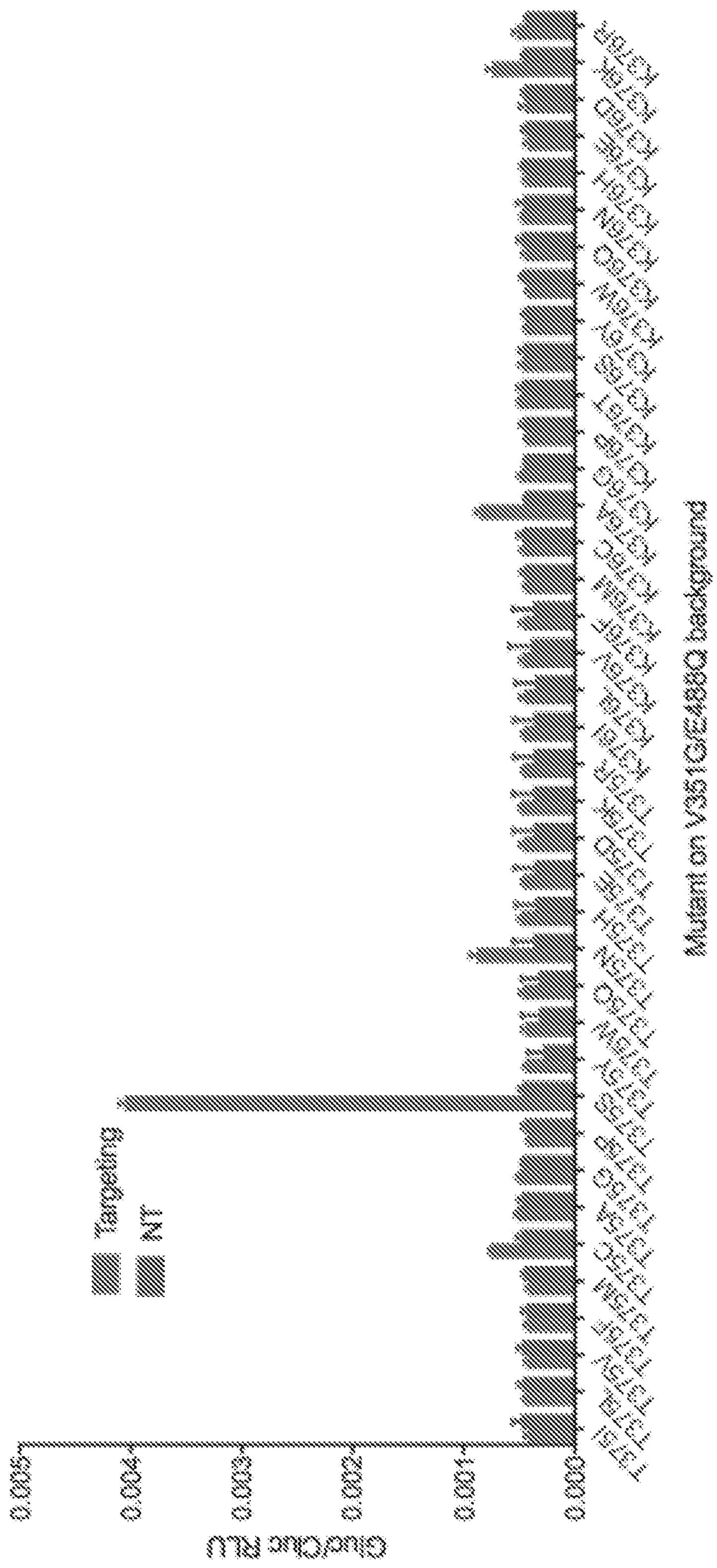
FIG. 17 is a graph depicting identification of new T375 and K376 mutants. Selected sites (T375, K376) were mutagenized to all 20 possible residues and tested on a background of REPAIR [E488Q, V351G]. Constructs were tested on the TCG luciferase motif and selected on the basis of luciferase activity.
Figure 18:
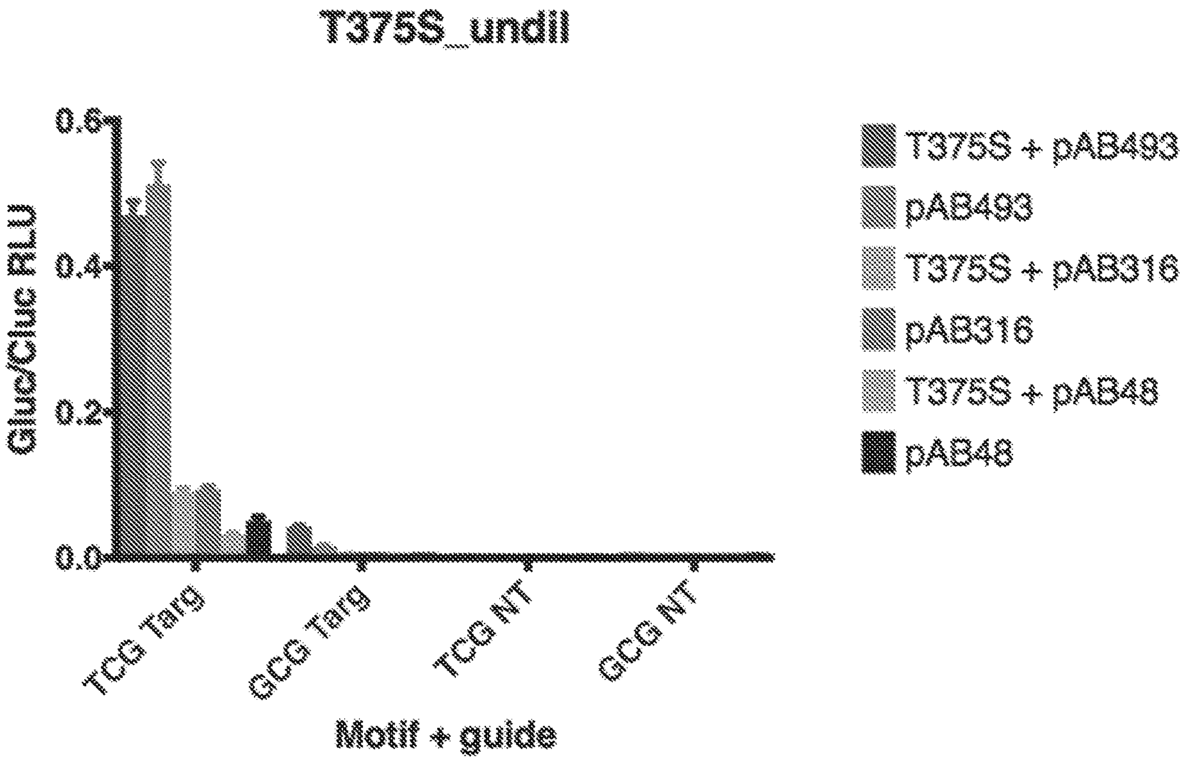
FIG. 18 is a graph showing that T375S has relaxed motif. T375S was tested against the [S486A, V351G, E488Q] background (pAB493), [V351G, E488Q] background (pAB316), and the E488Q background (pAB48) on all TCG and GCG motifs, with luciferase activity as a readout. T375S improves GCG motif.
Figure 19:
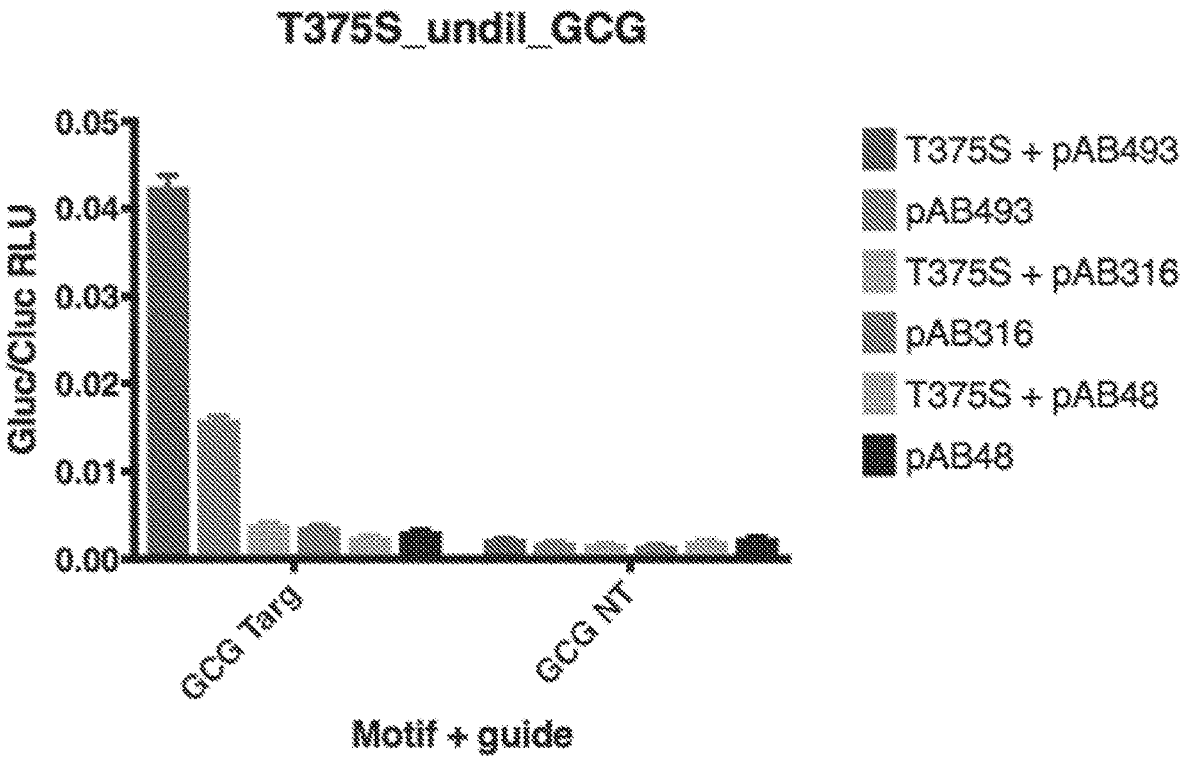
FIG. 19 is a graph showing that T375S has relaxed motif. T375S was tested against the [S486A, V351G, E488Q] background (pAB493), [V351G, E488Q] background (pAB316), and the E488Q background (pAB48) on GCG motifs, with luciferase activity as a readout. T375S improves GCG motif.
Figure 20:
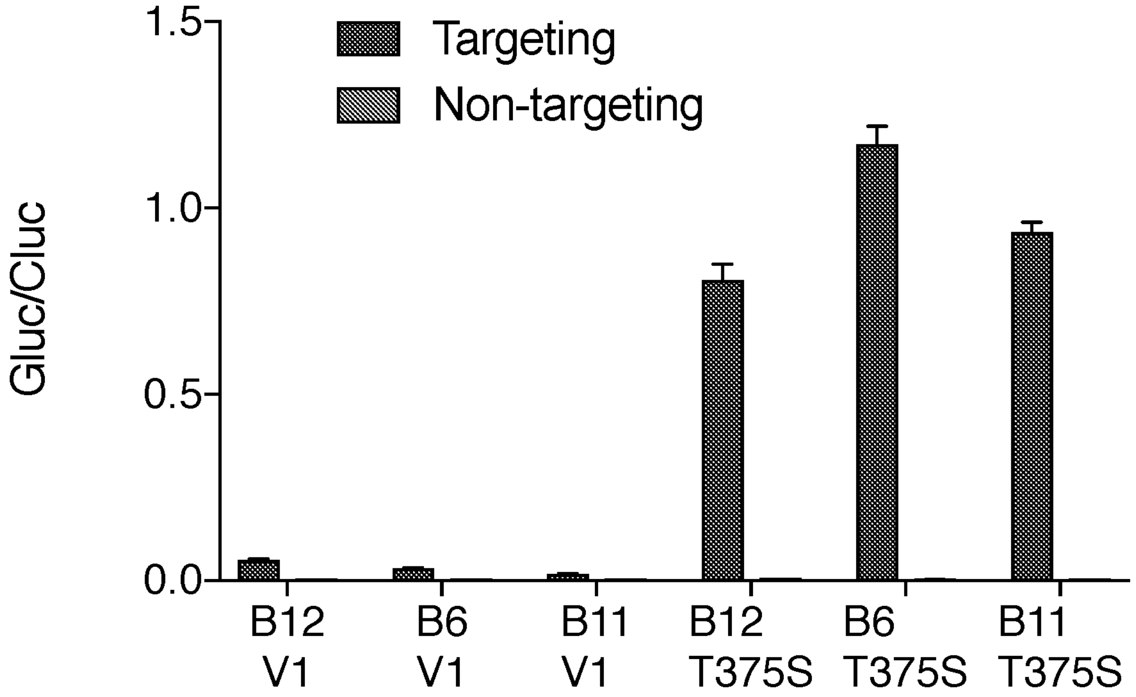
FIG. 20 is a graph depicting that B6 and B11 orthologs show improved RESCUE activity. Cas13b orthologs Cas13b6 (RanCas13b) and Cas13b11 (PguCas13b) were tested with T375S mutation, and show improved activity as measured by luciferase assay. Mutations shows are on corresponding backgrounds (T375S=T375S/S486A/V351G/E448Q).
Figure 21:
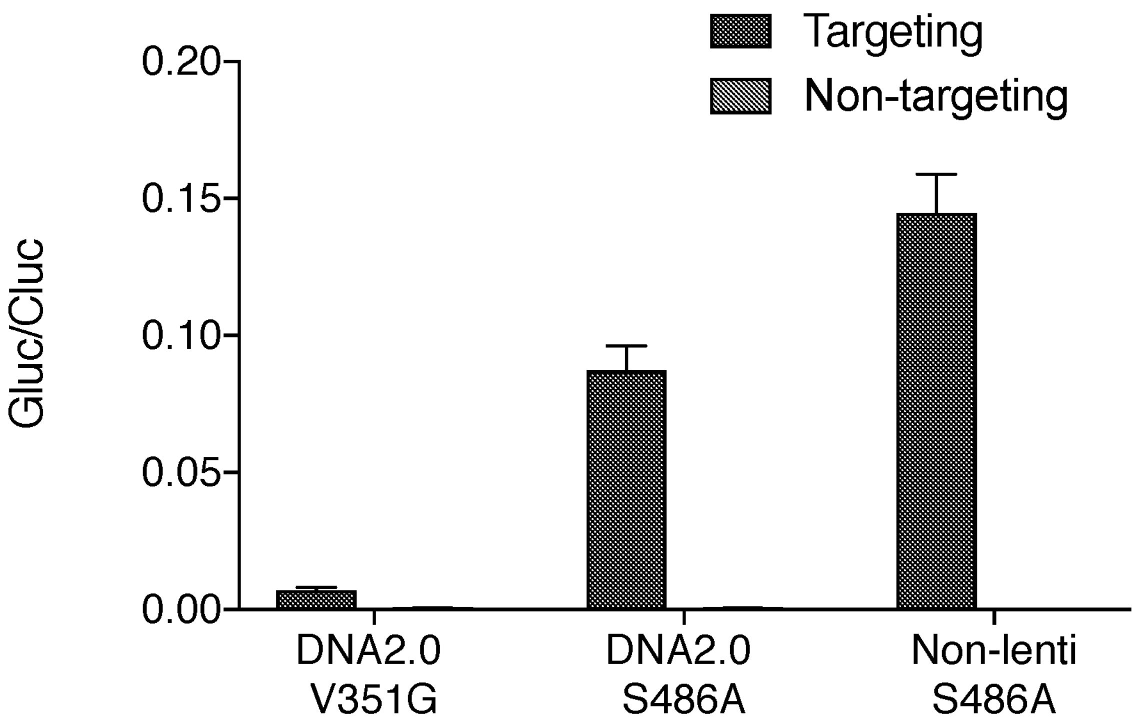
FIG. 21 is a graph showing that DNA2.0 vectors has comparable luciferase to transient transfection vectors. RESCUE vectors based off of either DNA2.0 (now Atum) constructs compared to a non-lenti vector, with Cas13b11 (PguCas13b) show improved luciferase activity. The Atum vector map (benchling.com/s/seq-DENgx9izDhsRTFFgy71K) has additional EES elements for expression. Mutations shows are on corresponding backgrounds (V351G=V351G/E448Q, S486A=S486A/V351G/E448Q).
Figure 22A:
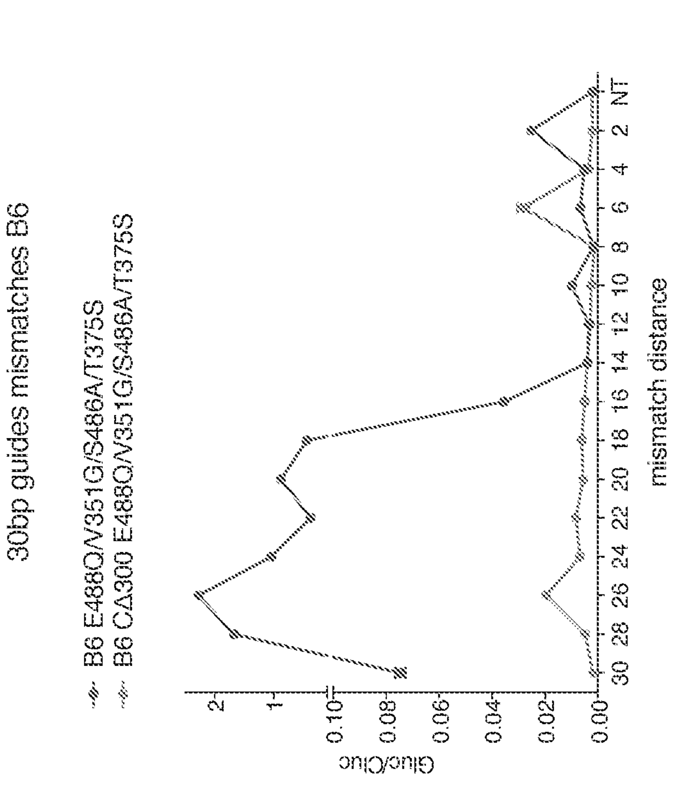
FIG. 22A is a graph showing luciferase results of testing truncations validated by REPAIR (B6 Cdelta300) with RESCUE using 30 bp guides.
Figure 22B:
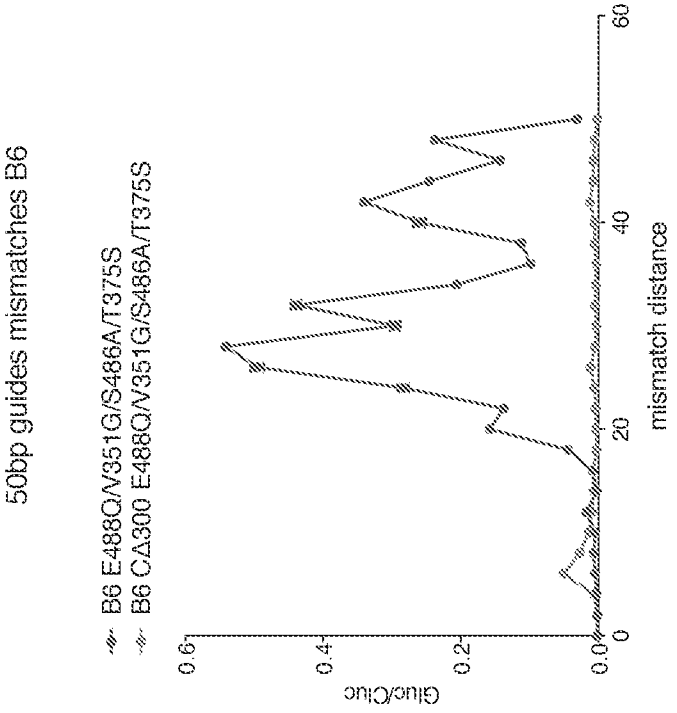
FIG. 22B is a graph showing luciferase results of testing truncations validated by REPAIR (B6 Cdelta300) with RESCUE using 50 bp guides. The 26 mismatch distance (as measured by the 5' end) shows the optimal activity with both full length and truncated versions).
Figure 23A:
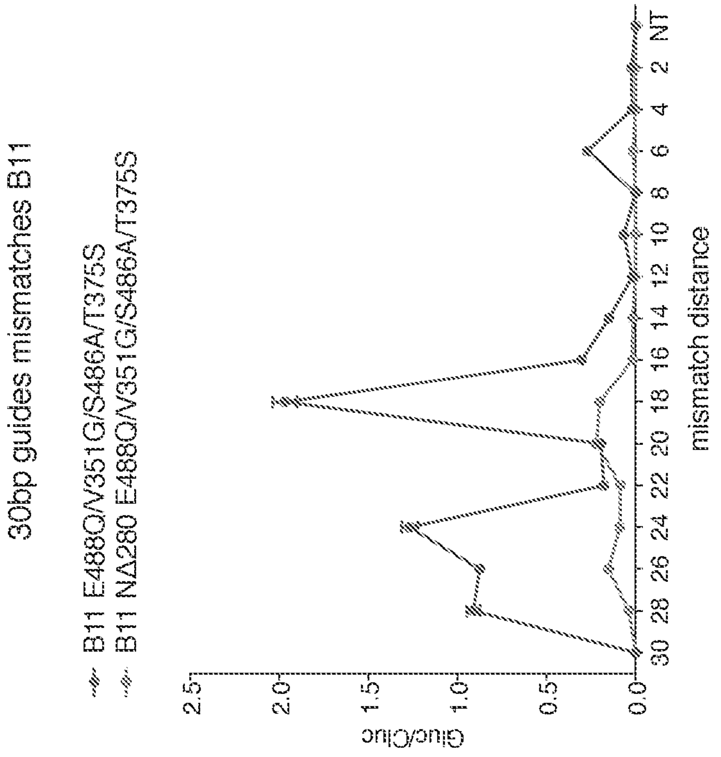
FIG. 23A is a graph showing luciferase results of testing truncations validated by REPAIR (B11 Ndelta280) with RESCUE using 30 bp guides.
Figure 23B:
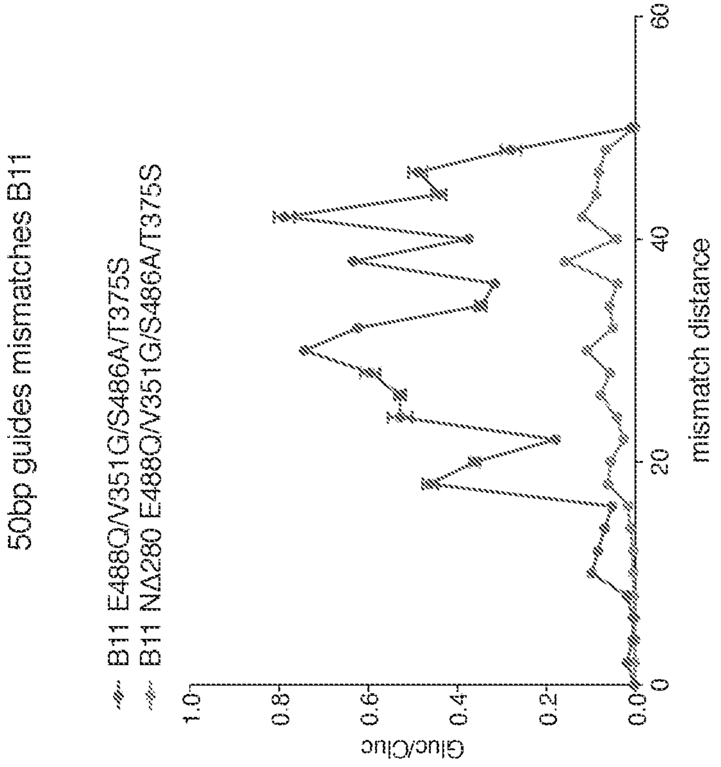
FIG. 23B is a graph showing luciferase results of testing truncations validated by REPAIR (B11 Ndelta280) with RESCUE using 50 bp guides. The 26 mismatch distance (as measured by the 5' end) shows the optimal activity with both full length and truncated versions).
Figure 24:
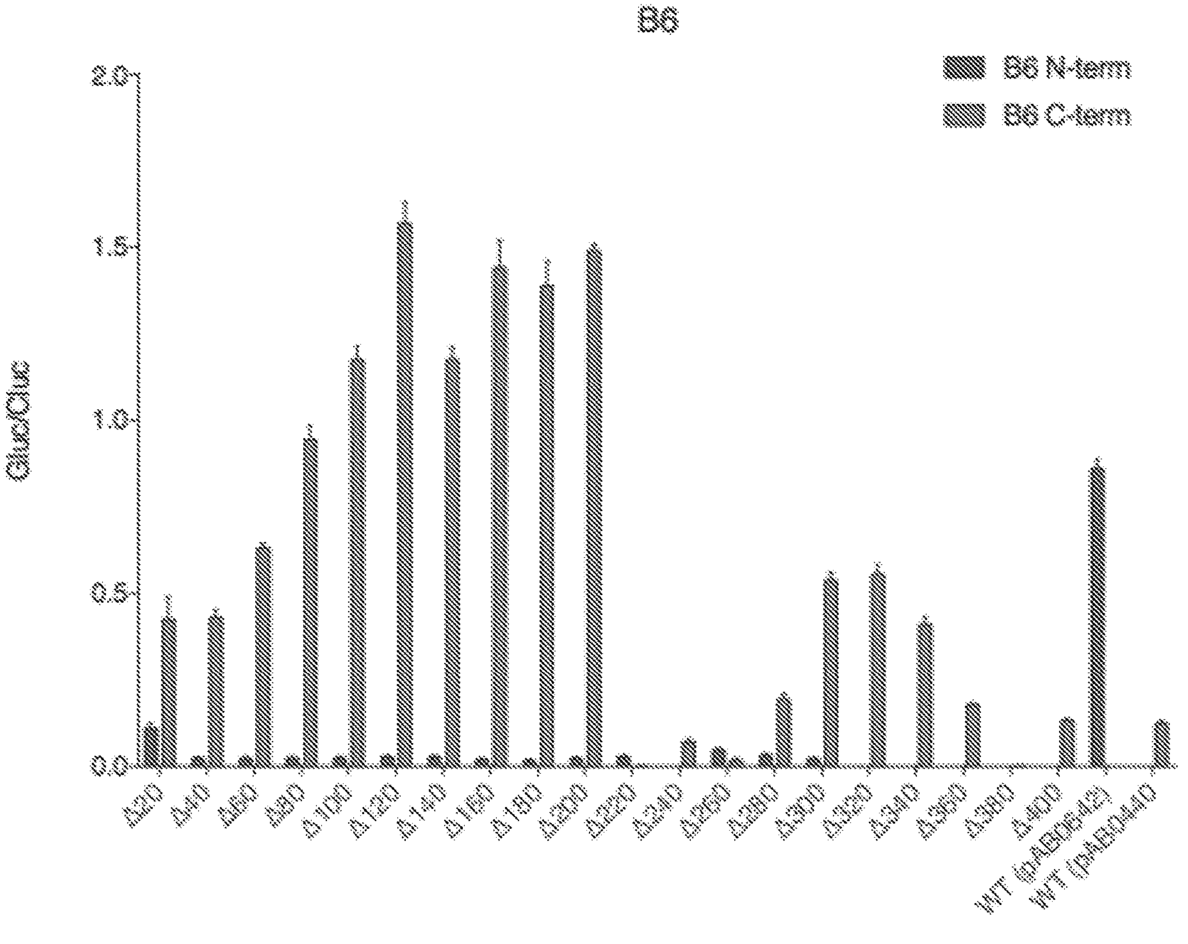
FIG. 24 is a graph showing results of testing all B6 truncations. Iterative truncations were generated from the N and C termini on RanCas13b (B6), with the T375S/S486A/V351G/E448Q mutation, with optimal activity up to C-delta 200, and activity at C-delta 320. Truncations are tested on luciferase, and editing is read out as luciferase activity. Missing bars indicate no data. The pAB0642 is an untruncated N-term control, T375S/S486A/V351G/E448Q. The pAB0440 is an untruncated C-term control, E448Q. All N-term constructs, and pAB0642, have an mark NES linker. All C-term constrcuts, and pAB0440, have a HIV-NES linker.
Figure 25:
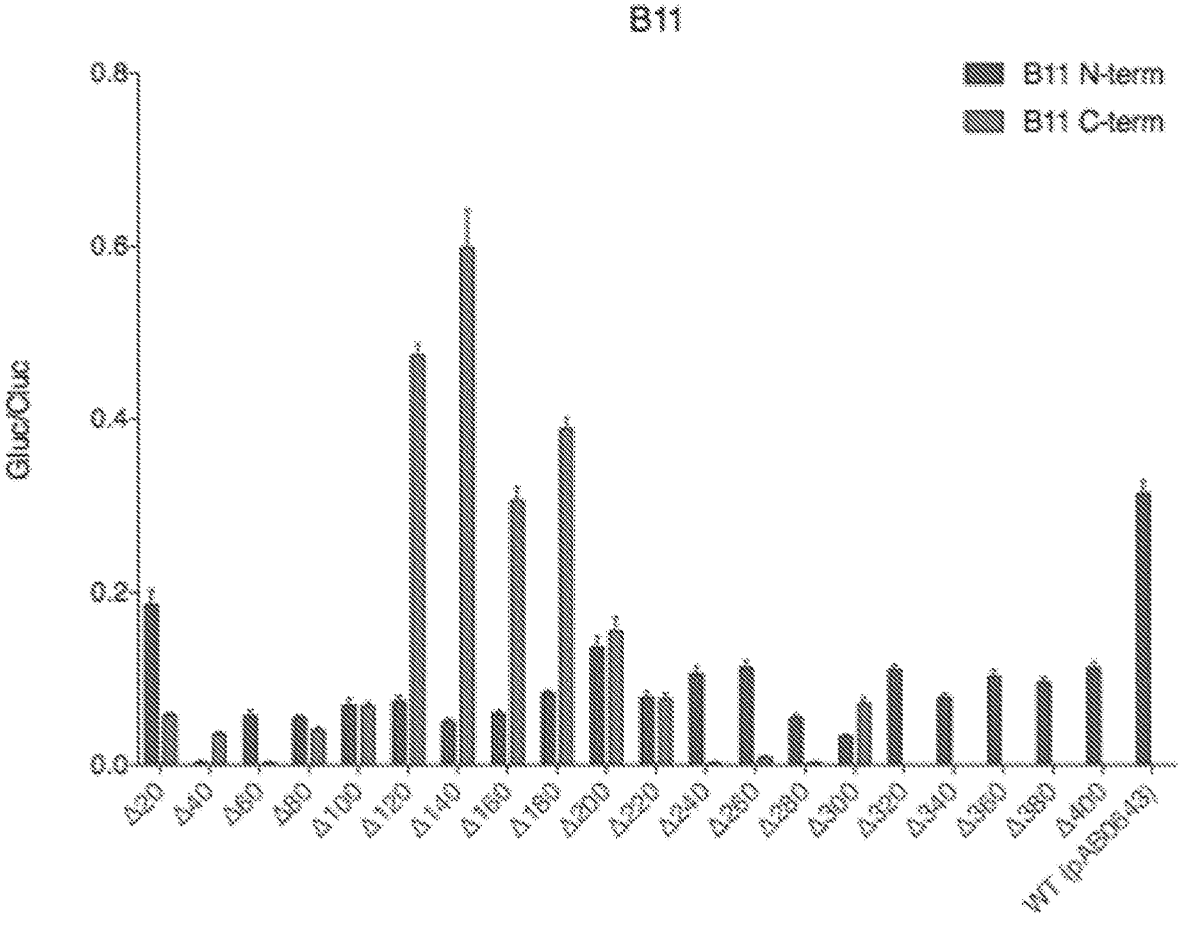
FIG. 25 is a graph showing results of testing all B11 truncations. Iterative truncations were generated from the N and C termini on PguCas13b (B11), with the T375S/S486A/V351G/E448Q mutation. Truncations are tested on luciferase, and editing is read out as luciferase activity.
Figure 26A:
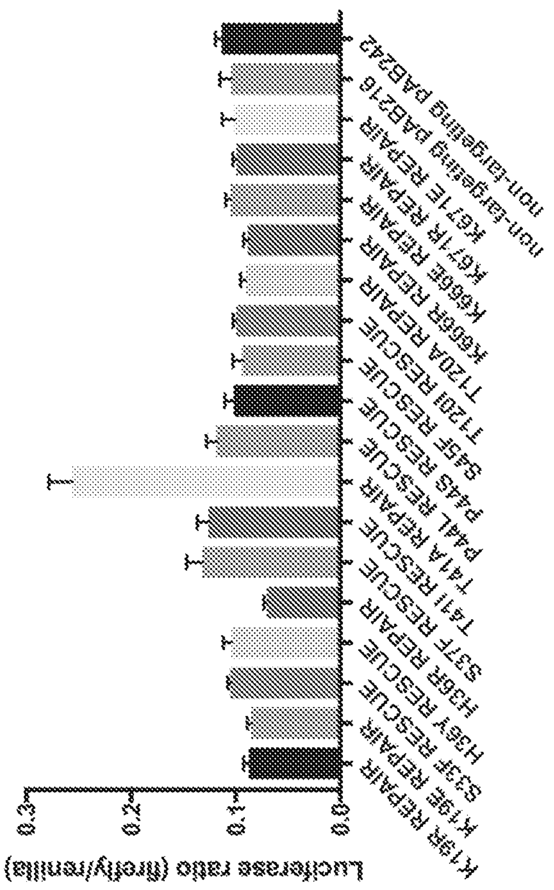
FIG. 26A is a graph showing Beta catenin modulation with REPAIR/RESCUE as measured by Beta-catenin activity via the TCF-LEF RE Wnt pathway reporter (Promega).
Figure 26B:
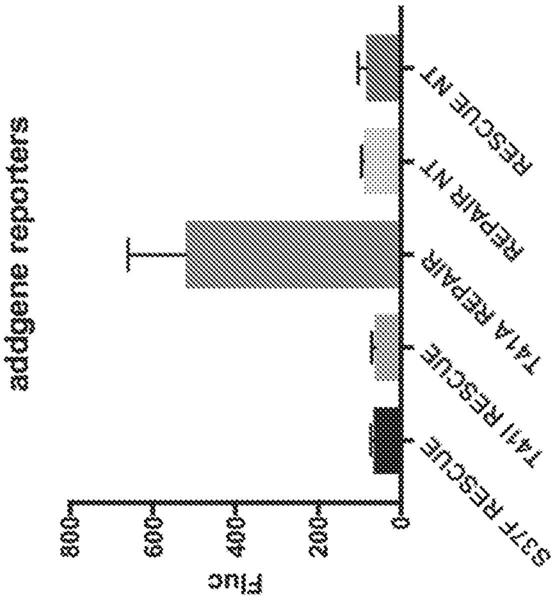
FIG. 26B is a graph showing Beta catenin modulation with REPAIR/RESCUE as measured by the M50 Super 8× TOPFlash reporter (Addgene). Beta-catenin/Wnt pathway induction is tested by using RNA editing to remove phosphorylation sites on Beta catenin. Guides targeting beta-catenin for either REPAIR (RanCas13b ortholog, E488Q mutation) or RESCUE (RanCas13b ortholog, T375S/S486A/V351G/E448Q mutation) were tested for phenotypic activity. The T41A guide shows activity on both reporters.
Figure 27:
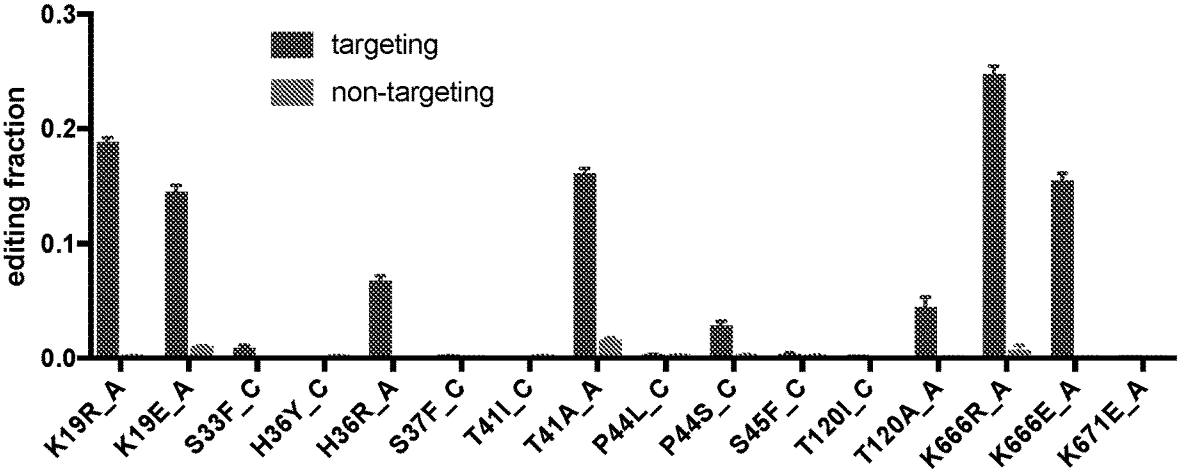
FIG. 27 is a graph showing NGS results of Beta catenin modulation. NGS readouts of either A-I(A) or C-U(C) activity at targeted sites by either REPAIR (RanCas13b ortholog, E488Q mutation) or RESCUE (RanCas13b ortholog, T375S/S486A/V351G/E448Q mutation. REPAIR was used on A targets, and RESCUE was used on C targets.
Figure 28:
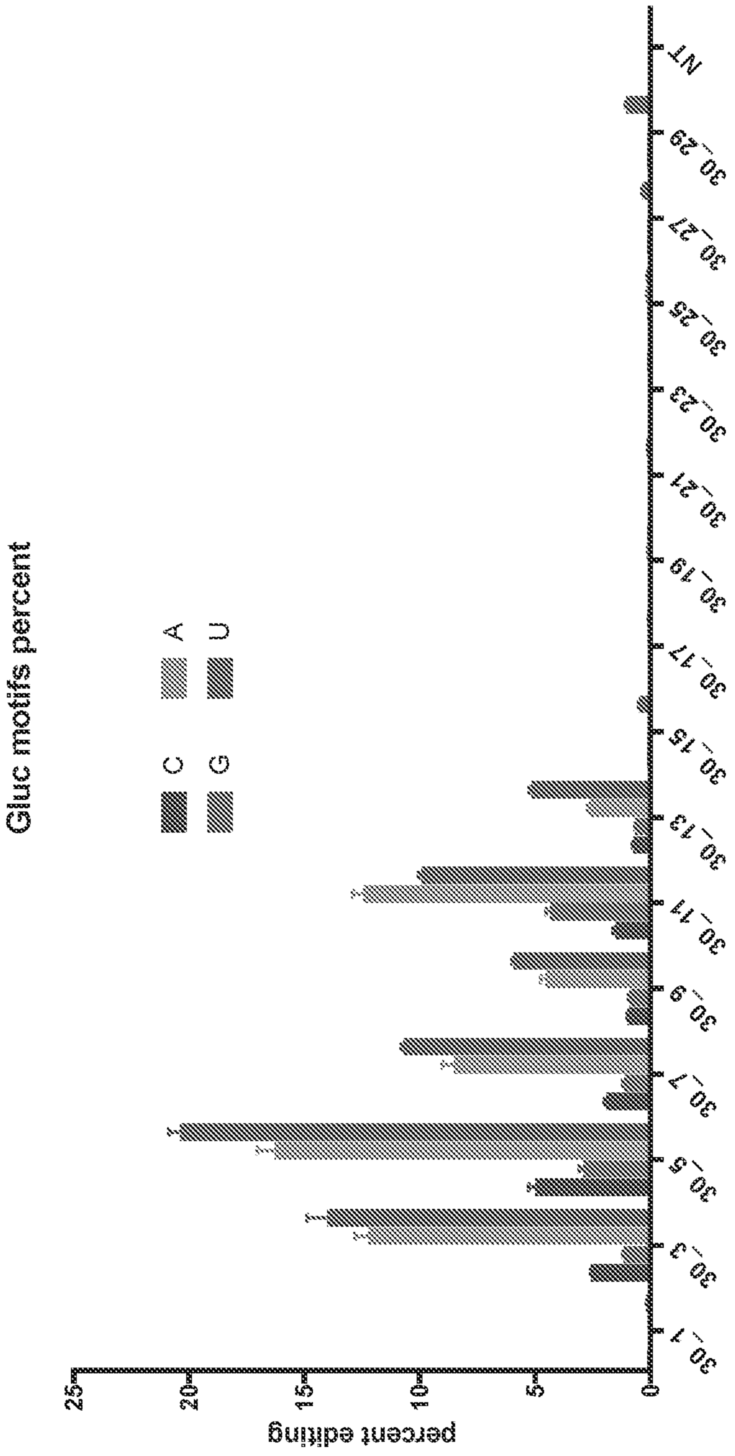
FIG. 28 is a graph depicting that tiling different guides shows improved motif activity at the 30_5 mutation (mismatch is 26 nt away from the 5' of the guide). All four motifs were tested with various tiling guides for luciferase activity. Nomenclature corresponds to distance from the 3' end of the spacer (i.e., 26 nt mismatch is 30_5). The 26 mismatch distance (as measured by the 5' end) shows the optimal activity with most motifs. Guides were tested with RESCUE (RanCas13b ortholog, T375S/S486A/V351G/E448Q mutation.

Additional guides were designed to test guide design on cytidine deaminase activity of various fusion protein constructs. See FIG. 5 and FIG. 6. The guide sequences used are provided in the Tables below

| Position | Guide sequence (SEQ ID NOS: 201-216) | Guide seq + G (SEQ ID NOS: 217-232) | Revcom (SEQ ID NOS: 233-248) | Top order (SEQ ID NOS: 249-264) | Bottom order (SEQ ID NOS: 265-280) |
|---|---|---|---|---|---|
| 0 | CTCTTTGTCGCCTTCGTAGGTGTGGCAGCG | GCTCTTTGTCGCCTTCGTAGGTGTGGCAGCG | cgctgccacacctacgaaggcgacaaagagc | caccGCTCTTTGTCGCCTTCGTAGGTGTGGCAGCG | Caaccgctgccacacctacgaaggcgacaaagagc |
| 6 | GTCGCCTTCGTAGGTGTGGCAGCGTCCTGG | GGTCGCCTTCGTAGGTGTGGCAGCGTCCTGG | ccaggacgctgccacacctacgaaggcgacc | caccGGTCGCCTTCGTAGGTGTGGCAGCGTCCTGG | Caacccaggacgctgccacacctacgaaggcgacc |
| 12 | TTCGTAGGTGTGGCAGCGTCCTGGGATGAA | GTTCGTAGGTGTGGCAGCGTCCTGGGATGAA | ttcatcccaggacgctgccacacctacgaac | caccGTTCGTAGGTGTGGCAGCGTCCTGGGATGAA | Caacttcatcccaggacgctgccacacctacgaac |
| 18 | GGTGTGGCAGCGTCCTGGGATGAACTTCTT | GGGTGTGGCAGCGTCCTGGGATGAACTTCTT | aagaagttcatcccaggacgctgccacaccc | caccGGGTGTGGCAGCGTCCTGGGATGAACTTCTT | Caacaagaagttcatcccaggacgctgccacaccc |
| 24 | GCAGCGTCCTGGGATGAACTTCTTCATCTT | GGCAGCGTCCTGGGATGAACTTCTTCATCTT | aagatgaagaagttcatcccaggacgctgcc | caccGGCAGCGTCCTGGGATGAACTTCTTCATCTT | Caacaagatgaagaagttcatcccaggacgctgcc |
| 30 | TCCTGGGATGAACTTCTTCATCTTGGGCGT | GTCCTGGGATGAACTTCTTCATCTTGGGCGT | acgcccaagatgaagaagttcatcccaggac | caccGTCCTGGGATGAACTTCTTCATCTTGGGCGT | Caacacgcccaagatgaagaagttcatcccaggac |
| 36 | GATGAACTTCTTCATCTTGGGCGTGCGCTT | GGATGAACTTCTTCATCTTGGGCGTGCGCTT | aagcgcacgcccaagatgaagaagttcatcc | caccGGATGAACTTCTTCATCTTGGGCGTGCGCTT | Caacaagcgcacgcccaagatgaagaagttcatcc |
| 42 | CTTCTTCATCTTGGGCGTGCGCTTGATGTG | GCTTCTTCATCTTGGGCGTGCGCTTGATGTG | cacatcaagcgcacgcccaagatgaagaagc | caccGCTTCTTCATCTTGGGCGTGCGCTTGATGTG | Caaccacatcaagcgcacgcccaagatgaagaagc |
| 48 | CATCTTGGGCGTGCGCTTGATGTGGGACAG | GCATCTTGGGCGTGCGCTTGATGTGGGACAG | ctgtcccacatcaagcgcacgcccaagatgc | caccGCATCTTGGGCGTGCGCTTGATGTGGGACAG | Caacctgtcccacatcaagcgcacgcccaagatgc |
| 54 | GGGCGTGCGCTTGATGTGGGACAGGCAGAT | GGGGCGTGCGCTTGATGTGGGACAGGCAGAT | atctgcctgtcccacatcaagcgcacgcccc | caccGGGGCGTGCGCTTGATGTGGGACAGGCAGAT | Caacatctgcctgtcccacatcaagcgcacgcccc |
| 60 | GCGCTTGATGTGGGACAGGCAGATCAGACA | GGCGCTTGATGTGGGACAGGCAGATCAGACA | tgtctgatctgcctgtcccacatcaagcgcc | caccGGCGCTTGATGTGGGACAGGCAGATCAGACA | Caactgtctgatctgcctgtcccacatcaagcgcc |
| 66 | GATGTGGGACAGGCAGATCAGACAGCCCCT | GGATGTGGGACAGGCAGATCAGACAGCCCCT | aggggctgtctgatctgcctgtcccacatcc | caccGGATGTGGGACAGGCAGATCAGACAGCCCCT | Caacaggggctgtctgatctgcctgtcccacatcc |
| 72 | GGACAGGCAGATCAGACAGCCCCTGGTGCA | GGGACAGGCAGATCAGACAGCCCCTGGTGCA | tgcaccaggggctgtctgatctgcctgtccc | caccGGGACAGGCAGATCAGACAGCCCCTGGTGCA | Caactgcaccaggggctgtctgatctgcctgtccc |

-continued

| Position | Guide sequence (SEQ ID NOS: 201-216) | Guide seq + G (SEQ ID NOS: 217-232) | Revcom (SEQ ID NOS: 233-248) | Top order (SEQ ID NOS: 249-264) | Bottom order (SEQ ID NOS: 265-280) |
|---|---|---|---|---|---|
| 78 | GCAGATCAGACAGCCCCTGGTGCAGCCAGC | GGCAGATCAGACAGCCCCTGGTGCAGCCAGC | gctggctgcaccaggggctgtctgatctgcc | caccGGCAGATCAGACAGCCCCTGGTGCAGCCAGC | Caacgctggctgcaccaggggctgtctgatctgcc |
| 84 | CAGACAGCCCCTGGTGCAGCCAGCTTTCCG | GCAGACAGCCCCTGGTGCAGCCAGCTTTCCG | cggaaagctggctgcaccagggggctgtctgc | caccGCAGACAGCCCCTGGTGCAGCCAGCTTTCCG | Caaccggaaagctggctgcaccaggggctgtctgc |
| NT | GTAATGCCTGGCTTGTCGACGCATAGTCTG | GGTAATGCCTGGCTTGTCGACGCATAGTCTG | cagactatgcgtcgacaagccaggcattacc | caccGGTAATGCCTGGCTTGTCGACGCATAGTCTG | Caaccagactatgcgtcgacaagccaggcattacc |

| Well position | Sequence Name | Sequence SEQ ID NOS: 281-312 |
|---|---|---|
| A1 | Guide_0_F | caccGCTCTTTGTCGCCTTCGTAGGTGTGGCAGCG |
| B1 | Guide_6_F | caccGGTCGCCTTCGTAGGTGTGGCAGCGTCCTGG |
| C1 | Guide_12_F | caccGTTCGTAGGTGTGGCAGCGTCCTGGGATGAA |
| D1 | Guide_18_F | caccGGGTGTGGCAGCGTCCTGGGATGAACTTCTT |
| E1 | Guide_24_F | caccGGCAGCGTCCTGGGATGAACTTCTTCATCTT |
| F1 | Guide_30_F | caccGTCCTGGGATGAACTTCTTCATCTTGGGCGT |
| G1 | Guide_36_F | caccGGATGAACTTCTTCATCTTGGGCGTGCGCTT |
| H1 | Guide_42_F | caccGCTTCTTCATCTTGGGCGTGCGCTTGATGTG |
| A2 | Guide_48_F | caccGCATCTTGGGCGTGCGCTTGATGTGGGACAG |
| B2 | Guide_54_F | caccGGGGCGTGCGCTTGATGTGGGACAGGCAGAT |
| C2 | Guide_60_F | caccGGCGCTTGATGTGGGACAGGCAGATCAGACA |
| D2 | Guide_66_F | caccGGATGTGGGACAGGCAGATCAGACAGCCCCT |
| E2 | Guide_72_F | caccGGGACAGGCAGATCAGACAGCCCCTGGTGCA |
| F2 | Guide_78_F | caccGGCAGATCAGACAGCCCCTGGTGCAGCCAGC |
| G2 | Guide_84_F | caccGCAGACAGCCCCTGGTGCAGCCAGCTTTCCG |
| H2 | Guide_NT_F | caccGGTAATGCCTGGCTTGTCGACGCATAGTCTG |
| A1 | Guide_0_R | caaccgctgccacacctacgaaggcgacaaagagc |
| B1 | Guide_6_R | caacccaggacgctgccacacctacgaaggcgacc |
| C1 | Guide_12_R | caacttcatcccaggacgctgccacacctacgaac |
| D1 | Guide_18_R | caacaagaagttcatcccaggacgctgccacaccc |
| E1 | Guide_24_R | caacaagatgaagaagttcatcccaggacgctgcc |
| F1 | Guide_30_R | caacacgcccaagatgaagaagttcatcccaggac |
| G1 | Guide_36_R | caacaagcgcacgcccaagatgaagaagttcatcc |
| H1 | Guide_42_R | caaccacatcaagcgcacgcccaagatgaagaagc |
| A2 | Guide_48_R | caacctgtcccacatcaagcgcacgcccaagatgc |
| B2 | Guide_54_R | caacatctgcctgtcccacatcaagcgcacgcccc |
| C2 | Guide_60_R | caactgtctgatctgcctgtcccacatcaagegcc |

-continued

| Well position | Sequence Name | Sequence SEQ ID NOS: 281-312 |
|---|---|---|
| D2 | Guide_66_R | caacaggggctgtctgatctgcctgtcccacatcc |
| E2 | Guide_72_R | caactgcaccaggggctgtctgatctgcctgtccc |
| F2 | Guide_78_R | caacgctggctgcaccaggggctgtctgatctgcc |
| G2 | Guide_84_R | caaccggaaagctggctgcaccaggggctgtctgc |
| H2 | Guide_NT_R | caaccagactatgogtcgacaagccaggcattacc |

SEQUENCE LISTING (326 sequences)

SEQ ID NO: 1 - protein, 15 aa, Artificial Sequence
  Synthetic
GGGGSGGGGSGGGGS

SEQ ID NO: 2 - protein, 20 aa, Artificial Sequence
  Synthetic
GGGGSGGGGSGGGGSGGGGS

SEQ ID NO: 3 - protein, 25 aa, Artificial Sequence
  Synthetic
GGGGSGGGGSGGGGSGGGGSGGGGS

SEQ ID NO: 4 - protein, 30 aa, Artificial Sequence
  Synthetic
GGGGSGGGGSGGGGSGGGGSGGGGSGGGGS

SEQ ID NO: 5 - protein, 35 aa, Artificial Sequence
  Synthetic
GGGGSGGGGSGGGGSGGGGSGGGGSGGGGSGGGGS

SEQ ID NO: 6 - protein, 40 aa, Artificial Sequence
  Synthetic
GGGGSGGGGSGGGGSGGGGSGGGGSGGGGSGGGGSGGGGS

SEQ ID NO: 7 - protein, 45 aa, Artificial Sequence
  Synthetic
GGGGSGGGGSGGGGSGGGGSGGGGSGGGGSGGGGSGGGGSGGGGS

SEQ ID NO: 8 - protein, 50 aa, Artificial Sequence
  Synthetic
GGGGSGGGGSGGGGSGGGGSGGGGSGGGGSGGGGSGGGGSGGGGSGGGGS

SEQ ID NO: 9 - protein, 55 aa, Artificial Sequence
  Synthetic
GGGGSGGGGSGGGGSGGGGSGGGGSGGGGSGGGGSGGGGSGGGGSGGGGSGGGGS

SEQ ID NO: 10 - protein, 15 aa, Artificial Sequence
  Synthetic
GSGGSGGSGGSGGSG

SEQ ID NO: 11 - protein, 32 aa, Artificial Sequence
  Synthetic
LEPGEKPYKCPECGKSFSQSGALTRHQRTHTR

SEQ ID NO: 12 - DNA, 132 bp, Cypridina sp.
agcagttccacacactcgcttctggaacgtctgaggttatcaataagctcctagtccagacgccgccaccacgaagaccttaattcttgccgttgcattagtctactgcgccactgttcattgccaggactg

SEQ ID NO: 13 - DNA, 132 bp, Cyprindina sp.
tcgtcaaggtgtgtgagcgaagaccttgcagactccaatagttattcgaggatcaggtctgcggcggtggtgcttctggaattaagaacggcaacgtaatcagatgacgcggtgacaagtaacggtcctgac

SEQ ID NO: 14 - protein, 21 aa, Cyprindina sp.
TKTLILAVALVYCATVHCQDC

SEQ ID NO: 15 - DNA, 36 bp, Cyprindina sp.
tggaggtgctcaaagagatggaagccaatgcccgga

SEQ ID NO: 16 - DNA, 34 bp, Artificial Sequence
  Synthetic
agagatggaagccaatgcccggaaagctggctgc

SEQ ID NO: 17 - DNA, 36 bp, Artificial Sequence
  Synthetic
  misc_feature (1)..(1): n is a, c, g, or t
nggaggtgctcaaagagatggaagccaatgcccgga

SEQ ID NO: 18 - DNA, 36 bp, Artificial Sequence
  Synthetic
  misc_feature (2)..(2): n is a, c, g, or t
tngaggtgctcaaagagatggaagccaatgcccgga

SEQ ID NO: 19 - DNA, 36 bp, Artificial Sequence
  Synthetic
  misc_feature (3)..(3): n is a, c, g, or t
tgnaggtgctcaaagagatggaagccaatgcccgga

SEQ ID NO: 20 - DNA, 36 bp, Artificial Sequence
  Synthetic
  misc_feature (4)..(4): n is a, c, g, or t
tggnggtgctcaaagagatggaagccaatgcccgga

SEQ ID NO: 21 - DNA, 36 bp, Artificial Sequence
  Synthetic
  misc_feature (4)..(4): n is a, c, g, or t
  misc_feature (36)..(36): n is a, c, g, or t
tggnggtgctcaaagagatggaagccaatgcccggn

SEQ ID NO: 22 - DNA, 34 bp, Artificial Sequence
  Synthetic
  misc_feature (1)..(1): n is a, c, g, or t
ngagatggaagccaatgcccggaaagctggctgc

SEQ ID NO: 23 - DNA, 34 bp, Artificial Sequence
  Synthetic
  misc_feature (2)..(2): n is a, c, g, or t
anagatggaagccaatgcccggaaagctggctgc

SEQ ID NO: 24 - DNA, 34 bp, Artificial Sequence
  Synthetic
  misc_feature (3)..(3): n is a, c, g, or t
agngatggaagccaatgcccggaaagctggctgc

SEQ ID NO: 25 - DNA, 34 bp, Artificial Sequence
  Synthetic
  misc_feature (4)..(4): n is a, c, g, or t
aganatggaagccaatgcccggaaagctggctgc

SEQ ID NO: 26 - DNA, 34 bp, Artificial Sequence
  Synthetic
  misc_feature (34)..(34): n is a, c, g, or t
agagatggaagccaatgcccggaaagctggctgn

SEQ ID NO: 27 - DNA, 36 bp, Artificial Sequence
  Synthetic
  misc_feature (1)..(2): n is a, c, g, or t
nngaggtgctcaaagagatggaagccaatgcccgga

SEQ ID NO: 28 - DNA, 36 bp, Artificial Sequence
  Synthetic
  misc_feature (1)..(1): n is a, c, g, or t
  misc_feature (3)..(3): n is a, c, g, or t
ngnaggtgctcaaagagatggaagccaatgcccgga

SEQ ID NO: 29 - DNA, 36 bp, Artificial Sequence
  Synthetic
  misc_feature (1)..(1): n is a, c, g, or t
  misc_feature (4)..(4): n is a, c, g, or t
nggnggtgctcaaagagatggaagccaatgcccgga

SEQ ID NO: 30 - DNA, 36 bp, Artificial Sequence
  Synthetic
  misc_feature (1)..(1): n is a, c, g, or t
  misc_feature (5)..(5): n is a, c, g, or t
nggangtgctcaaagagatggaagccaatgcccgga

SEQ ID NO: 31 - DNA, 36 bp, Artificial Sequence
  Synthetic
  misc_feature (35)..(36): n is a, c, g, or t
tggaggtgctcaaagagatggaagccaatgcccgnn

SEQ ID NO: 32 - DNA, 34 bp, Artificial Sequence
  Synthetic
  misc_feature (1)..(2): n is a, c, g, or t
nnagatggaagccaatgcccggaaagctggctgc

SEQ ID NO: 33 - DNA, 34 bp, Artificial Sequence
  Synthetic
  misc_feature (1)..(1): n is a, c, g, or t
  misc_feature (3)..(3): n is a, c, g, or t
ngngatggaagccaatgcccggaaagctggctgc

SEQ ID NO: 34 - DNA, 34 bp, Artificial Sequence
  Synthetic
  misc_feature (1)..(1): n is a, c, g, or t
  misc_feature (4)..(4): n is a, c, g, or t
nganatggaagccaatgcccggaaagctggctgc

SEQ ID NO: 35 - DNA, 34 bp, Artificial Sequence
  Synthetic
  misc_feature (1)..(1): n is a, c, g, or t
  misc_feature (5)..(5): n is a, c, g, or t
ngagntggaagccaatgcccggaaagctggctgc

SEQ ID NO: 36 - DNA, 34 bp, Artificial Sequence
  Synthetic
  misc_feature (33)..(34): n is a, c, g, or t
agagatggaagccaatgcccggaaagctggctnn

SEQ ID NO: 37 - protein, 9 aa, Artificial Sequence
  Synthetic
GGSGGSGGS

SEQ ID NO: 38 - protein, 60 aa, Artificial Sequence
  Synthetic
GGGGSGGGGSGGGGSGGGGSGGGGSGGGGSGGGGSGGGGSGGGGSGGGGSGGGGSGGGGS

SEQ ID NO: 39 - protein, 5 aa, Artificial Sequence
  Synthetic
GGGGS

SEQ ID NO: 40 - protein, 10 aa, Artificial Sequence
  Synthetic
GGGGSGGGGS

SEQ ID NO: 41 - protein, 20 aa, Artificial Sequence
  Synthetic
PKKKRKVEASSPKKRKVEAS

SEQ ID NO: 42 - protein, 229 aa, Rattus sp. [sequence omitted]

SEQ ID NO: 43 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 44 - protein, 325 aa, Homo sapiens
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 45 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 46 - protein, 200 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPYLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLLD

SEQ ID NO: 47 - protein, 181 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 48 - protein, 84 aa, Escherica coli
MTNLSDIIEKETGKQLVIQESILMLPEEVEEVIGNKPESDILVHTAYDESTDENVMLLTSDAPEYKPWALVIQDSNGENKIKML

SEQ ID NO: 49 - protein, 7 aa, Simian virus 40
PKKKRKV

SEQ ID NO: 50 - protein, 10 aa, Artificial Sequence
  Synthetic
PKKKRKVEAS

SEQ ID NO: 51 - protein, 16 aa, Artificial Sequence
  Synthetic
KRPAATKKAGQAKKKK

SEQ ID NO: 52 - protein, 9 aa, Artificial Sequence
  Synthetic
PAAKRVKLD

SEQ ID NO: 53 - protein, 11 aa, Artificial Sequence
  Synthetic
RQRRNELKRSP

SEQ ID NO: 54 - protein, 38 aa, Artificial Sequence
  Synthetic
NQSSNFGPMKGGNFGGRSSGPYGGGGQYFAKPRNQGGY

SEQ ID NO: 55 - protein, 42 aa, Artificial Sequence
  Synthetic
RMRIZFKNKGKDTAELRRRRVEVSVELRKAKKDEQILKRRNV

SEQ ID NO: 56 - protein, 8 aa, Artificial Sequence
  Synthetic
VSRKRPRP

SEQ ID NO: 57 - protein, 8 aa, Artificial Sequencen
  Synthetic
PPKKARED

SEQ ID NO: 58 - protein, 8 aa, Homo sapiens
PQPKKKPL

SEQ ID NO: 59 - protein, 12 aa, Mus
SALIKKKKKMAP

SEQ ID NO: 60 - protein, 5 aa, Influenza virus
DRLRR

SEQ ID NO: 61 - protein, 7 aa, Influenza virus
PKQKKRK

SEQ ID NO: 62 - protein, 10 aa, Hepatitis virus
RKLKKKIKKL

SEQ ID NO: 63 - protein, 10 aa, Mus
REKKKFLKRR

SEQ ID NO: 64 - protein, 20 aa, Homo sapiens
KRKGDEVDGVDEVAKKKSKK

SEQ ID NO: 65 - protein, 17 aa, Homo sapiens
RKCLQAGMNLEARKTKK

SEQ ID NO: 66 - protein, 4 aa, Artificial Sequence
  Synthetic
  misc_feature (1)..(1): Xaa can be any naturally occurring amino acid
XTEN

SEQ ID NO: 67 - protein, 1340 aa, Lachnospiracea bacterium
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 68 - protein, 1437 aa, Lachnospiracea bacterium
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 69 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 70 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 71 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 72 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 73 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 74 - protein, 1051 aa, Listeriaceae bacterium
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 75 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 76 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 77 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 78 - protein, 1285 aa, Rhodobacter capsulatus; identical to SEQ ID NO: 77

SEQ ID NO: 79 - protein, 1389 aa, Artificial Sequence
  Synthetic
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 80 - protein, 1197 aa, L wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 81 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 82 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 83 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 84 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 85 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 86 - protein, 1276 aa, Blautia sp.
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 87 - protein, 1385 aa, Leptotrichia sp.
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 88 - protein, 1334 aa, Lachnospiraceae bacterium
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 89 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 90 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 91 - protein, 1235 aa, Thalassospira sp.
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 92 - protein, 1312 aa, Pseudobutyrivibrio sp.
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 93 - protein, 1343 aa, Butyrivibrio sp.
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 94 - protein, 1276 aa, Blautia sp.; identical to SEQ ID NO: 86

SEQ ID NO: 95 - protein, 1168 aa, Leptotrichia sp.
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 96 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 97 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 98 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 99 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 100 - protein, 1224 aa, Insolitispirillum peregrinum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 101 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 102 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 103 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 104 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 105 - protein, 953 aa, Alistipes sp.
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 106 - protein, 1322 aa, Prevotella sp.
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 107 - protein, 1322 aa, Prevotella sp.; identical to SEQ ID NO: 106

SEQ ID NO: 108 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 109 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 110 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 111 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 112 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 113 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 114 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 115 - protein, 1090 aa, Prevotella sp
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 116 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 117 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 118 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 119 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 120 - protein, 1175 aa, Porphyromonas sp.
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 121 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 122 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 123 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 124 - protein, 1127 aa, Prevotella buccae; identical to SEQ ID NO: 102

SEQ ID NO: 125 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 126 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 127 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 128 - protein, 1224 aa, Bergeyella zoohelcum; identical to SEQ ID NO: 100

SEQ ID NO: 129 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 130 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 131 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 132 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 133 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 134 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 135 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 136 - protein, 1161 aa, Bacteroides bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 137 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 138 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 139 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 140 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 141 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 142 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 143 - protein, 1125 aa, Prevotella pallens; identical to SEQ ID NO: 125

SEQ ID NO: 144 - protein, 1157 aa, Myroides odoratimimus; identical to SEQ ID NO: 126

SEQ ID NO: 145 - protein, 1157 aa, Myroides odoratimimus; identical to SEQ ID NO: 127

SEQ ID NO: 146 - protein, 1127 aa, Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 147 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 148 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 149 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 150 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 151 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 152 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 153 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 154 - protein, 1135 aa, Porphyromonas gingivalis; identical to SEQ ID NO: 132

SEQ ID NO: 155 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 156 - protein, 1135 aa, Porphyromonas gingivalis; identical to SEQ ID NO: 133

SEQ ID NO: 157 - protein, 1135 aa, Porphyromonas gingivalis; identical to SEQ ID NO: 134

SEQ ID NO: 158 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 159 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 160 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 161 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 162 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 163 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 164 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 165 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 166 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 167 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 168 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 169 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 170 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 171 - protein, 1090 aa, Prevotella sp
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 172 - protein, 1090 aa, Prevotella sp
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 173 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 174 - protein, 1155 aa, Flavobacterium sp.
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 175 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 176 - protein, 1145 aa, Chryseobacterium sp.
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 177 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 178 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 179 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 180 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 181 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 182 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 183 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 184 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 185 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 186 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 187 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 188 - protein, 1115 aa, Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 189 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 190 - protein, 1110 aa, Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 191 - protein, 668 aa, Fusobacterium necrophorum
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 192 - protein, 1121 aa, Fusobacterium necrophorum
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 193 - protein, 897 aa, Fusobacterium necrophorum
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 194 - protein, 1111 aa, Fusobacterium necrophorum
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 195 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 196 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 197 - protein, 236 aa, Homo sapiens; identical to SEQ ID NO: 43

SEQ ID NO: 198 - protein, 198 aa, Homo sapiens [sequence omitted]

SEQ ID NO: 199 - protein, 229 aa, Homo sapiens
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 200 - protein, 229 aa, Artificial Sequences [sequence omitted]

SEQ ID NO: 201 - DNA, 30 bp, Artificial Sequences
  Synthetic
ctctttgtcgccttcgtaggtgtggcagcg

SEQ ID NO: 202 - DNA, 30 bp, Artificial Sequences
  Synthetic
gtcgccttcgtaggtgtggcagcgtcctgg

SEQ ID NO: 203 - DNA, 30 bp, Artificial Sequences
  Synthetic
ttcgtaggtgtggcagcgtcctgggatgaa

SEQ ID NO: 204 - DNA, 30 bp, Artificial Sequences
  Synthetic
ggtgtggcagcgtcctgggatgaacttctt

SEQ ID NO: 205 - DNA, 30 bp, Artificial Sequences
  Synthetic
gcagcgtcctgggatgaacttcttcatctt

SEQ ID NO: 206 - DNA, 30 bp, Artificial Sequences
  Synthetic
tcctgggatgaacttcttcatcttgggcgt

SEQ ID NO: 207 - DNA, 30 bp, Artificial Sequences
  Synthetic
gatgaacttcttcatcttgggcgtgcgctt

SEQ ID NO: 208 - DNA, 30 bp, Artificial Sequences
  Synthetic
cttcttcatcttgggcgtgcgcttgatgtg

SEQ ID NO: 209 - DNA, 30 bp, Artificial Sequences
  Synthetic
catcttgggcgtgcgcttgatgtgggacag

SEQ ID NO: 210 - DNA, 30 bp, Artificial Sequences
  Synthetic
gggcgtgcgcttgatgtgggacaggcagat

SEQ ID NO: 211 - DNA, 30 bp, Artificial Sequences
  Synthetic
gcgcttgatgtgggacaggcagatcagaca

SEQ ID NO: 212 - DNA, 30 bp, Artificial Sequences
  Synthetic
gatgtgggacaggcagatcagacagcccct

SEQ ID NO: 213 - DNA, 30 bp, Artificial Sequences
  Synthetic
ggacaggcagatcagacagcccctggtgca

SEQ ID NO: 214 - DNA, 30 bp, Artificial Sequences
  Synthetic
gcagatcagacagcccctggtgcagccagc

SEQ ID NO: 215 - DNA, 30 bp, Artificial Sequences
  Synthetic
cagacagcccctggtgcagccagctttccg

SEQ ID NO: 216 - DNA, 30 bp, Artificial Sequences
  Synthetic
gtaatgcctggcttgtcgacgcatagtctg

SEQ ID NO: 217 - DNA, 31 bp, Artificial Sequences
  Synthetic
gctctttgtcgccttcgtaggtgtggcagcg

SEQ ID NO: 218 - DNA, 31 bp, Artificial Sequences
  Synthetic
ggtcgccttcgtaggtgtggcagcgtcctgg

SEQ ID NO: 219 - DNA, 31 bp, Artificial Sequences
  Synthetic
gttcgtaggtgtggcagcgtcctgggatgaa

SEQ ID NO: 220 - DNA, 31 bp, Artificial Sequences
  Synthetic
gggtgtggcagcgtcctgggatgaacttctt

SEQ ID NO: 221 - DNA, 31 bp, Artificial Sequences
  Synthetic
ggcagcgtcctgggatgaacttcttcatctt

SEQ ID NO: 222 - DNA, 31 bp, Artificial Sequences
  Synthetic
gtcctgggatgaacttcttcatcttgggcgt

SEQ ID NO: 223 - DNA, 31 bp, Artificial Sequences
  Synthetic
ggatgaacttcttcatcttgggcgtgcgctt

SEQ ID NO: 224 - DNA, 31 bp, Artificial Sequences
  Synthetic
gcttcttcatcttgggcgtgcgcttgatgtg

SEQ ID NO: 225 - DNA, 31 bp, Artificial Sequences
  Synthetic
gcatcttgggcgtgcgcttgatgtgggacag

SEQ ID NO: 226 - DNA, 31 bp, Artificial Sequences
  Synthetic
ggggcgtgcgcttgatgtgggacaggcagat

SEQ ID NO: 227 - DNA, 31 bp, Artificial Sequences
  Synthetic
ggcgcttgatgtgggacaggcagatcagaca

SEQ ID NO: 228 - DNA, 31 bp, Artificial Sequences
  Synthetic
ggatgtgggacaggcagatcagacagcccct

SEQ ID NO: 229 - DNA, 31 bp, Artificial Sequences
  Synthetic
gggacaggcagatcagacagcccctggtgca

SEQ ID NO: 230 - DNA, 31 bp, Artificial Sequences
  Synthetic
ggcagatcagacagcccctggtgcagccagc

SEQ ID NO: 231 - DNA, 31 bp, Artificial Sequences
  Synthetic
gcagacagcccctggtgcagccagctttccg

SEQ ID NO: 232 - DNA, 31 bp, Artificial Sequences
  Synthetic
ggtaatgcctggcttgtcgacgcatagtctg

SEQ ID NO: 233 - DNA, 31 bp, Artificial Sequences
  Synthetic
cgctgccacacctacgaaggcgacaaagagc

SEQ ID NO: 234 - DNA, 31 bp, Artificial Sequences
  Synthetic
ccaggacgctgccacacctacgaaggcgacc

SEQ ID NO: 235 - DNA, 31 bp, Artificial Sequences
  Synthetic
ttcatcccaggacgctgccacacctacgaac

SEQ ID NO: 236 - DNA, 31 bp, Artificial Sequences
  Synthetic
aagaagttcatcccaggacgctgccacaccc

SEQ ID NO: 237 - DNA, 31 bp, Artificial Sequences
  Synthetic
aagatgaagaagttcatcccaggacgctgcc

SEQ ID NO: 238 - DNA, 31 bp, Artificial Sequences
  Synthetic
acgcccaagatgaagaagttcatcccaggac

SEQ ID NO: 239 - DNA, 31 bp, Artificial Sequences
  Synthetic
aagcgcacgcccaagatgaagaagttcatcc

SEQ ID NO: 240 - DNA, 31 bp, Artificial Sequences
  Synthetic
cacatcaagcgcacgcccaagatgaagaagc

SEQ ID NO: 241 - DNA, 31 bp, Artificial Sequences
  Synthetic
ctgtcccacatcaagcgcacgcccaagatgc

SEQ ID NO: 242 - DNA, 31 bp, Artificial Sequences
  Synthetic
atctgcctgtcccacatcaagcgcacgcccc

SEQ ID NO: 243 - DNA, 31 bp, Artificial Sequences
  Synthetic
tgtctgatctgcctgtcccacatcaagcgcc

SEQ ID NO: 244 - DNA, 31 bp, Artificial Sequences
  Synthetic
aggggctgtctgatctgcctgtcccacatcc

SEQ ID NO: 245 - DNA, 31 bp, Artificial Sequences
  Synthetic
tgcaccaggggctgtctgatctgcctgtccc

SEQ ID NO: 246 - DNA, 31 bp, Artificial Sequences
  Synthetic
gctggctgcaccaggggctgtctgatctgcc

SEQ ID NO: 247 - DNA, 31 bp, Artificial Sequences
  Synthetic
cggaaagctggctgcaccaggggctgtctgc

SEQ ID NO: 248 - DNA, 31 bp, Artificial Sequences
  Synthetic
cagactatgcgtcgacaagccaggcattacc

SEQ ID NO: 249 - DNA, 35 bp, Artificial Sequences
  Synthetic
caccgctctttgtcgccttcgtaggtgtggcagcg

SEQ ID NO: 250 - DNA, 35 bp, Artificial Sequences
  Synthetic
caccggtcgccttcgtaggtgtggcagcgtcctgg

SEQ ID NO: 251 - DNA, 35 bp, Artificial Sequences
  Synthetic
caccgttcgtaggtgtggcagcgtcctgggatgaa

SEQ ID NO: 252 - DNA, 35 bp, Artificial Sequences
  Synthetic
caccgggtgtggcagcgtcctgggatgaacttctt

SEQ ID NO: 253 - DNA, 35 bp, Artificial Sequences
  Synthetic
caccggcagcgtcctgggatgaacttcttcatctt

SEQ ID NO: 254 - DNA, 35 bp, Artificial Sequences
  Synthetic
caccgtcctgggatgaacttcttcatcttgggcgt

SEQ ID NO: 255 - DNA, 35 bp, Artificial Sequences
  Synthetic
caccggatgaacttcttcatcttgggcgtgcgctt

SEQ ID NO: 256 - DNA, 35 bp, Artificial Sequences
  Synthetic
caccgcttcttcatcttgggcgtgcgcttgatgtg

SEQ ID NO: 257 - DNA, 35 bp, Artificial Sequences
  Synthetic
caccgcatcttgggcgtgcgcttgatgtgggacag

SEQ ID NO: 258 - DNA, 35 bp, Artificial Sequences
  Synthetic
caccggggcgtgcgcttgatgtgggacaggcagat

SEQ ID NO: 259 - DNA, 35 bp, Artificial Sequences
  Synthetic
caccggcgcttgatgtgggacaggcagatcagaca

SEQ ID NO: 260 - DNA, 35 bp, Artificial Sequences
  Synthetic
caccggatgtgggacaggcagatcagacagcccct

SEQ ID NO: 261 - DNA, 35 bp, Artificial Sequences
  Synthetic
caccgggacaggcagatcagacagcccctggtgca

SEQ ID NO: 262 - DNA, 35 bp, Artificial Sequences
  Synthetic
caccggcagatcagacagcccctggtgcagccagc

SEQ ID NO: 263 - DNA, 35 bp, Artificial Sequences
  Synthetic
caccgcagacagcccctggtgcagccagctttccg

SEQ ID NO: 264 - DNA, 35 bp, Artificial Sequences
  Synthetic
caccggtaatgcctggcttgtcgacgcatagtctg

SEQ ID NO: 265 - DNA, 35 bp, Artificial Sequences
  Synthetic
caaccgctgccacacctacgaaggcgacaaagagc

SEQ ID NO: 266 - DNA, 35 bp, Artificial Sequences
  Synthetic
caacccaggacgctgccacacctacgaaggcgacc

SEQ ID NO: 267 - DNA, 35 bp, Artificial Sequences
  Synthetic
caacttcatcccaggacgctgccacacctacgaac

SEQ ID NO: 268 - DNA, 35 bp, Artificial Sequences
  Synthetic
caacaagaagttcatcccaggacgctgccacaccc

SEQ ID NO: 269 - DNA, 35 bp, Artificial Sequences
  Synthetic
caacaagatgaagaagttcatcccaggacgctgcc

SEQ ID NO: 270 - DNA, 35 bp, Artificial Sequences
  Synthetic
caacacgcccaagatgaagaagttcatcccaggac

SEQ ID NO: 271 - DNA, 35 bp, Artificial Sequences
  Synthetic
caacaagcgcacgcccaagatgaagaagttcatcc

SEQ ID NO: 272 - DNA, 35 bp, Artificial Sequences
  Synthetic
caaccacatcaagcgcacgcccaagatgaagaagc

SEQ ID NO: 273 - DNA, 35 bp, Artificial Sequences
  Synthetic
caacctgtcccacatcaagcgcacgcccaagatgc

SEQ ID NO: 274 - DNA, 35 bp, Artificial Sequences
  Synthetic
caacatctgcctgtcccacatcaagcgcacgcccc

SEQ ID NO: 275 - DNA, 35 bp, Artificial Sequence
  Synthetic
caactgtctgatctgcctgtcccacatcaagcgcc

SEQ ID NO: 276 - DNA, 35 bp, Artificial Sequences
  Synthetic
caacaggggctgtctgatctgcctgtcccacatcc

SEQ ID NO: 277 - DNA, 35 bp, Artificial Sequences
  Synthetic
caactgcaccaggggctgtctgatctgcctgtccc

SEQ ID NO: 278 - DNA, 35 bp, Artificial Sequences
  Synthetic
caacgctggctgcaccaggggctgtctgatctgcc

SEQ ID NO: 279 - DNA, 35 bp, Artificial Sequences
  Synthetic
caaccggaaagctggctgcaccaggggctgtctgc

SEQ ID NO: 280 - DNA, 35 bp, Artificial Sequences
  Synthetic
caaccagactatgcgtcgacaagccaggcattacc

SEQ ID NO: 281 - DNA, 35 bp, Artificial Sequences; identical to SEQ ID NO: 249
  Synthetic

SEQ ID NO: 282 - DNA, 35 bp, Artificial Sequences; identical to SEQ ID NO: 250
  Synthetic

SEQ ID NO: 283 - DNA, 35 bp, Artificial Sequences; identical to SEQ ID NO: 251
  Synthetic

SEQ ID NO: 284 - DNA, 35 bp, Artificial Sequences; identical to SEQ ID NO: 252
  Synthetic

SEQ ID NO: 285 - DNA, 35 bp, Artificial Sequences; identical to SEQ ID NO: 253
  Synthetic

SEQ ID NO: 286 - DNA, 35 bp, Artificial Sequences; identical to SEQ ID NO: 254
  Synthetic

SEQ ID NO: 287 - DNA, 35 bp, Artificial Sequences; identical to SEQ ID NO: 255
  Synthetic

SEQ ID NO: 288 - DNA, 35 bp, Artificial Sequences; identical to SEQ ID NO: 256
  Synthetic

SEQ ID NO: 289 - DNA, 35 bp, Artificial Sequences; identical to SEQ ID NO: 257
  Synthetic

SEQ ID NO: 290 - DNA, 35 bp, Artificial Sequences; identical to SEQ ID NO: 258
  Synthetic

SEQ ID NO: 291 - DNA, 35 bp, Artificial Sequences; identical to SEQ ID NO: 259
  Synthetic

SEQ ID NO: 292 - DNA, 35 bp, Artificial Sequences; identical to SEQ ID NO: 260
  Synthetic

SEQ ID NO: 293 - DNA, 35 bp, Artificial Sequences; identical to SEQ ID NO: 261
  Synthetic

SEQ ID NO: 294 - DNA, 35 bp, Artificial Sequences; identical to SEQ ID NO: 262
  Synthetic

SEQ ID NO: 295 - DNA, 35 bp, Artificial Sequences; identical to SEQ ID NO: 263
  Synthetic

SEQ ID NO: 296 - DNA, 35 bp, Artificial Sequences; identical to SEQ ID NO: 264
  Synthetic

SEQ ID NO: 297 - DNA, 35 bp, Artificial Sequences; identical to SEQ ID NO: 265
  Synthetic

SEQ ID NO: 298 - DNA, 35 bp, Artificial Sequences; identical to SEQ ID NO: 266
  Synthetic

SEQ ID NO: 299 - DNA, 35 bp, Artificial Sequences; identical to SEQ ID NO: 267
  Synthetic

SEQ ID NO: 300 - DNA, 35 bp, Artificial Sequences; identical to SEQ ID NO: 268
  Synthetic

SEQ ID NO: 301 - DNA, 35 bp, Artificial Sequences; identical to SEQ ID NO: 269
  Synthetic

SEQ ID NO: 302 - DNA, 35 bp, Artificial Sequences; identical to SEQ ID NO: 270
  Synthetic

SEQ ID NO: 303 - DNA, 35 bp, Artificial Sequences; identical to SEQ ID NO: 271
  Synthetic

SEQ ID NO: 304 - DNA, 35 bp, Artificial Sequences; identical to SEQ ID NO: 272
  Synthetic

SEQ ID NO: 305 - DNA, 35 bp, Artificial Sequences; identical to SEQ ID NO: 273
  Synthetic

SEQ ID NO: 306 - DNA, 35 bp, Artificial Sequences; identical to SEQ ID NO: 274
  Synthetic

SEQ ID NO: 307 - DNA, 35 bp, Artificial Sequences; identical to SEQ ID NO: 275
  Synthetic

SEQ ID NO: 308 - DNA, 35 bp, Artificial Sequences; identical to SEQ ID NO: 276
  Synthetic

SEQ ID NO: 309 - DNA, 35 bp, Artificial Sequences; identical to SEQ ID NO: 277
  Synthetic

SEQ ID NO: 310 - DNA, 35 bp, Artificial Sequences; identical to SEQ ID NO: 278
  Synthetic

SEQ ID NO: 311 - DNA, 35 bp, Artificial Sequences; identical to SEQ ID NO: 279
  Synthetic

SEQ ID NO: 312 - DNA, 35 bp, Artificial Sequences; identical to SEQ ID NO: 280
  Synthetic

SEQ ID NO: 313 - DNA, 12 bp, Artificial Sequence
  Synthetic
acttgtttaagt

SEQ ID NO: 314 - DNA, 16 bp, Artificial Sequence
  Synthetic
ggcaccgagtcggtgc

SEQ ID NO: 315 - protein, 668 aa, Fusobacterium necrophorum; identical to SEQ ID NO: 191

SEQ ID NO: 316 - protein, 796 aa, Tissierella sp.
MEKDKKGEKIDISQEMIEEDLRKILILFSRLRHSMVHYDYEFYQALYSGKDFVISDKNNLENRMISQLLDLNIFKELSKVKLIKDKAISNYLDKNTTIHVLGQDIKAIRLLDIYRDICGSKNGFNKFINTMITISGEEDREYKEKVIEHFNKKMENLSTYLEKLEKQDNAKRNNKRVYNLLKQKLIEQQKLKEWFGGPYVYDIHSSKRYKELYIERKKLVDRHSKLFEEGLDEKNKKELTKINDELSKLNSEMKEMTKLNSKYRLQYKLQLAFGFILEEFDLNIDTFINNFDKDKDLIISNFMKKRDIYLNRVLDRGDNRLKNIIKEYKFRDTEDIFCNDRDNNLVKLYILMYILLPVEIRGDFLGFVKKNYYDMKHVDFIDKKDKEDKDTFFHDLRLFEKNIRKLEITDYSLSSGFLSKEHKVDIEKKINDFINRNGAMKLPEDITIEEFNKSLILPIMKNYQINFKLLNDIEISALFKIAKDRSITFKQAIDEIKNEDIKKNSKKNDKNNHKDKNINFTQLMKRALHEKIPYKAGMYQIRNNISHIDMEQLYIDPLNSYMNSNKNNITISEQIEKIIDVCVTGGVTGKELNNNIINDYYMKKEKLVFNLKLRKQNDIVSIESQEKNKREEFVFKKYGLDYKDGEINIIEVIQKVNSLQEELRNIKETSKEKLKNKETLFRDISLINGTIRKNINFKIKEMVLDIVRMDEIRHINIHIYYKGENYTRSNIIKFKYAIDGENKKYYLKQHEINDINLELKDKFVTLICNMDKHPNKNKQTINLESNYIQNVKFIIP

SEQ ID NO: 317 - protein, 897 aa, Fusobacterium ulcerans; identical to SEQ ID NO: 193

SEQ ID NO: 318 - protein, 919 aa, Cetobacterium sp.
MEEIKHKKNKSSIIRVIVSNYDMTGIKEIKVLYQKQGGVDTFNLKTIINLESGNLEIISCKPKEREKYRYEFNCKTEINTISITKKDKVLKKEIRKYSLELYFKNEKKDTVVAKVTDLLKAPDKIEGERNHLRKLSSSTERKLLSKTLCKNYSEISKTPIEEIDSIKIYKIKRFLNYRSNFLIYFALINDFLCAGVKEDDINEVWLIQDKEHTAFLENRIEKITDYIFDKLSKDIENKKNQFEKRIKKYKTSLEELKTETLEKNKTFYIDSIKTKITNLENKITELSLYNSKESLKEDLIKIISIFTNLRHSLMHYDYKSFENLFENIENEELKNLLDLNLFKSIRMSDEFKTKNRTNYLDGTESFTIVKKHQNLKKLYTYYNNLCDKKNGFNTFINSFFVTDGIENTDFKNLIILHFEKEMEEYKKSIEYYKIKISNEKNKSKKEKLKEKIDLLQSELINMREHKNLLKQIYFFDIHNSIKYKELYSERKNLIEQYNLQINGVKDVTAINHINTKLLSLKNKMDKITKQNSLYRLKYKLKIAYSFLMIEFDGDVSKFKNNFDPTNLEKRVEYLDKKEEYLNYTAPKNKFNFAKLEEELQKIQSTSEMGADYLNVSPENNLFKFYILTYIMLPVEFKGDFLGFVKNHYYNIKNVDFMDESLLDENEVDSNKLNEKIENLKDSSFFNKIRLFEKNIKKYEIVKYSVSTQENMKEYFKQLNLDIPYLDYKSTDEIGIFNKNMILPIFKYYQNVFKLCNDIEIHALLALANKKQQNLEYAIYCCSKKNSLNYNELLKTFNRKTYQNLSFIRNKIAHLNYKELFSDLFNNELDLNTKVRCLIEFSQNNKFDQIDLGMNFINDYYMKKTRFIFNQRRLRDLNVPSKEKIIDGKRKQQNDSNNELLKKYGLSRTNIKDIFNKAWY

SEQ ID NO: 319 - protein, 1110 aa, Fusobacterium necrophorum; identical to SEQ ID NO: 190

SEQ ID NO: 320 - protein, 1110 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 321 - protein, 1111 aa, Anaerosalibacter massiliensis; identical to SEQ ID NO: 194

SEQ ID NO: 322 - protein, 1111 aa, Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSVTERKLIEEKVAENYSLLANCPMEEVDSIKIYKIKRFLTYRSNMLLYFASINSFLCEGIKGKENETEEIWHLKDNDVRKEKVKENFKNKLIQSTENYNSSLKNQIEEKEKLLRKESKKGAFYRTIIKKLQQERIKELSEKSLTEDCEKIIKLYSKLRHSLMHYDYQYFENLFENKETPELKDKLDLHLFKSLPLIRKMKLNNKVNYLEDGDTLFVLQKTKKAKTLYQIYDALCEQKNGFNKFINDFFVSDGEENTVFKQIINEKFQSEMEFLGKRISESEEKNPKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKMAFGFLFCEFDGNISRFKDEFDASNQEKIIQYHKNGEKYLTYFLKEEEKEKFNLKKLQETIQKTGKENWLLPQNKNNLFKFYLLTYLLLPYELKGDFLGFVKKHYYDIKNVDFMDENQSSKIIESKEDDFYHKIRLFEKNTKKYEIVKYSIVPDEKLKQYFKDLGIDTKYLILEQKSEVSGEKNKKVSLKNNGMFNKTILLFVFKYYQIAFKLFNDIELYSLFFLREKSGKPFEVFLKELKDKMIGKQLNFGQLLYVIYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLGKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLMIEKNTLKISSNGKIISLVPHYSYSIDVKY

SEQ ID NO: 323 - protein, 1115 aa, Fusobacterium necrophorum; identical to SEQ ID NO: 188

SEQ ID NO: 324 - protein, 1121 aa, Fusobacterium perfoetens; identical to SEQ ID NO: 192

SEQ ID NO: 325 - protein, 1137 aa, Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 326 - protein, 1158 aa, Fusobacterium varium
MENKNKPNRGSIVRIIISNYDMKGIKELKVRYRKQAQLDTFILQTTLDKSNNSILINDFRVKAREKYRYSFTYDGKEKFSVPSNSIIVTKIDNAAPEKSKEIRKYKITLGIDEKCKTGSMITAAIEDLLEDDRVREGIRNPRRKASKTERKLITESICHNYAQITQCPVEEIDAVKIYKVKRFLSYRSNMLLFFALINDFLCKNLKNEKGEKINEIWEMENKGNNKKIDFDENYNILVAQIKEYFTKEIENYNNRIDNIIDKKELLKYSEEKEESEKNKKLEELNKLESQKLKILTDEEIKADVIKIIKIFSDLRHSLMHYEYKYFENLFENKKNEELAELLNLNLFKNLTLLRQMKIENKTNYLEGDEKFNILGKDVRAKNALGHYDLLVEQKNGFNNFINSFFVQDGTENLEFKKFIDENFIKAQKELEEDIKNCKESVKKLEKKLKENPKKSEDLEKKLEKKQKKLKELKKELEKMKQHYKRLNCAYVWDIHSSTVYKKLYNERKNLIEKYNKQLNGLQDKNAITGINAQLLRIKKEMEEITKSNSLFRLKYKMQIAYAFLEMEYEGNIAKFKNEFDCSKTEKIQEWLEKSEEYLNYCMEKEEDGKNYKFHFKEISEIKDTHNEEWLENTSENNLFKFYILTYLLLPMEFKGDFLGVVKKHYYDIKNVDFTDESEKELSQEQIDKMIGDSFFHKIRLFEKNTKRYEIIKYSILTSDEIKKYFELLELKVPYLEYKGIDEIGIFNKNIILPIFKYYQIIFRLYNDLEIHGLFNVSFDINKILSDLKSYGNENINFREFLYVIKQNNNSSTEEEYQKIWEKLESKYLKEPLLTPEKKEINKKTEKELKKLDGISFLRNKISHLEYEKIIEGVLKTAVNGENKKTSETNADKVFLNEKIKKIINFIKENELDKIELGFNFINDFFMKKEQFMFGQIKQVKEGNSDSITTERKRKEENNKRLKITYGLNYNNLSKIYEFSNTLREIVNSPLFLKDSTLLKKVDLSKVMLKEKPICSLQYENNTKLEDDIKRILLKDSSDIMGIYKAEVVKKLKEKLVLIFKYDEEKKIYVTVYDTSKAVPENISKEILVKRNNSKEEYFFEDNKKKYTTQYYTLEITKENELKVIPAKKLEGKEFKTEKKEENKLMLNNHYCFNVKIIY

What is claimed is:

1. An engineered composition for site-directed base editing comprising a targeting domain and a cytidine deaminase protein or catalytic domain thereof, wherein the targeting domain is a Cas13 protein, or fragment thereof which retains RNA binding ability, and a guide molecule, and wherein the cytidine deaminase protein or catalytic domain thereof is an apolipoprotein B mRNA-editing complex (APOBEC) family deaminase and directly fused to or linked via a flexible linker to a C-terminus of the Cas13 protein or fragment thereof which retains RNA binding ability, and wherein the APOBEC family deaminase is an APOBEC1 deaminase comprising one or more mutations corresponding to W90A, W90Y, W90F, R118A, H121R, H122R, R126A, R126E, or R132E in rat APOBEC1, or an APOBEC3G deaminase comprising one or more mutations corresponding to W285A, W285Y, W285F, R313A, D316R, D317R, R320A, R320E, or R326E in human APOBEC3G.

2. The engineered composition of claim 1, wherein the cytidine deaminase protein, or catalytic domain thereof comprises one or more mutations that increase activity or specificity of the cytidine deaminase protein relative to wild type.

3. The engineered composition of claim 1, wherein said flexible linker is $(GGGGS)_{3-11}$ (SEQ ID NO: 1-9), GSG5 (SEQ ID NO: 10), LEPGEKPYKCPECGKSFSQSGALTRHQRTHTR (SEQ ID NO: 11), or an XTEN linker (SEQ ID NO: 66).

4. The engineered composition of claim 1, wherein the Cas13 protein is catalytically inactive.

5. The engineered composition of claim 4, wherein the Cas13 protein is (a) a Cas13a;

(b) a Cas13b;

(c) a Cas13c;

(d) a Cas13 selected from any one of SEQ ID NO: 67-194, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, or SEQ ID NO: 326;

(e) a Cas13 from a bacterial species selected from any one of *Leptotrichia shahii, L wadei, L wadei* F0279, *Listeria seeligeri, Lachnospiraceae bacterium* MA2020, *Lachnospiraceae bacterium* NK4A179, [*Clostridium*] *aminophilum* DSM 10710, Carnobacterium *gallinarum* DSM 4847, *Paludibacter propionicigenes* WB4, *Listeria weihenstephanensis* FSL R9-0317, *Listeriaceae bacterium* FSL M6-0635, *Leptotrichia wadei* F0279, *Rhodobacter capsulatus* SB 1003, *Rhodobacter capsulatus* R121, *Rhodobacter capsulatus* DE442, *Leptotrichia buccalis* C-1013-b, *Herbinix hemicellulolytic,* [*Eubacterium*] rectangle, *Eubacteriaceae bacterium* CHKCI004, *Blautia* sp. Marseille-P2398, *Leptotrichia* sp. oral taxon 879 str. F0557, *Lachnospiraceae bacterium* NK4A144, *Chloroflexus aggregans, Demequina aurantiaca, Thalassospira* sp. TSL5-1, SAMN04487830_13920 [*Pseudobutyrivibrio* sp. OR37], SAMN02910398_00008 [*Butyrivibrio* sp. YAB3001], *Blautia* sp. Marseille-P2398, *Leptotrichia* sp. Marseille-P3007, *Bacteroides* huge, SAMN05216357_1045 [*Porphyromonadaceae bacterium* KH3CP3RA], *Listeria riparia, Insolitispirillum peregrinum, Bergeyella zoohelcum, Prevotella intermedia, Prevotella buccal, Porphyromonas gingivalis, Bacteroides pyogenes, Alistipes* sp. ZOR0009, *Prevotella* sp. MA2016, *Riemerella anatipestifer, Prevotella aurantiaca, Prevotella saccharolytica*, HMPREF9712 03108 [*Myroides odoratimimus* CCUG 10230], *Capnocytophaga canimorsus, Porphyromonas gulae, Prevotella* sp. P5-125, *Flavobacterium branchiophilum, Myroides odoratimimus, Flavobacterium columnare, Porphyromonas* sp. COT-052 OH4946, PIN17_0200 [*Prevotella intermedia* 17], HMPREF6485_0083 [*Prevotella buccae* ATCC 33574], HMPREF9144_1146 [*Prevotella pallens* ATCC 700821], HMPREF9714 02132 [*Myroides odoratimimus* CCUG 12901], HMPREF9711_00870 [*Myroides odoratimimus* CCUG 3837], HMPREF9699_02005 [*Bergeyella zoohelcum* ATCC 43767], HMPREF9151_01387 [*saccharolytica* F0055], A343_1752 [*Porphyromonas gingivalis* JCVI SC001], HMPREF1981_03090 [*Bacteroides pyogenes* F0041], HMPREF1553_02065 [*Porphyromonas gingivalis* F0568], HMPREF1988 01768 [*Porphyromonas gingivalis* F0185], HMPREF1990_01800 [*Porphyromonas gingivalis* W4087], M573 117042 [*Prevotella intermedia* ZT], A2033_10205 [*Bacteroidetes bacterium* GWA2 31_9], SAMN05421542_0666 [*Chryseobacterium jejuense*], SAMN05444360 11366 [*Chryseobacterium carnipullorum*], SAMN05421786_1011119 [*Chryseobacterium ureilyticum*], *Prevotella pallens, Prevotella* sp. MSX73, *Paludibacter propionicigenes, Psychroflexus torquis, Prevotella pleuritidis, Prevotella falsenii, Capnocytophaga cynodegmi, Prevotella* sp. P5-119, *Prevotella* sp. P4-76, *Prevotella* sp. P5-60, *Phaeodactylibacter xiamenensis, Flavobacterium* sp. 316, *Chryseobacterium* sp. YR477, *Sinomicrobium oceani, Reichenbachiella agariperforans, Fusobacterium necrophorum* subsp. *funduliforme, Fusobacterium necrophorum, Fusobacterium necrophorum* DJ-2, *Fusobacterium necrophorum* BFTR-1, *Fusobacterium perfoetens, Fusobacterium ulcerans, Anaerosalibacter massiliensis*, or *Anaerosalibacter* sp. ND11;

(f) a *Prevotella* sp.P5-125 Cas13b;

(g) a *Porphyromas gulae* Cas13b; or (h) a *Riemerella anatipestifer* Cas13b.

6. The engineered composition of claim 5, (a) wherein said Cas13 protein is a Cas13a protein that comprises one or more mutations in one or two HEPN domains in the Cas13a protein;

(b) wherein said Cas13 protein is a Cas13a protein that comprises mutations at amino acids at positions corresponding to R474 and R1046 of a wild type *Leptotrichia wadei* Cas13a; or (c) wherein said Cas13 protein is a Cas13b protein that comprises a mutation in one or more amino acid positions corresponding to one or more amino acid positions selected from the group consisting of R116, H121, R1177, and H1182 of a wild type *Bergeyella zoohelcum* ATCC 43767 Cas 13b protein; or (d) wherein said Cas13 protein is a Cas13b protein that comprises a mutation in one or more amino acid positions corresponding to one or more amino acids positions selected from the group consisting of R128, H133, R1053, and H1058 of a wild type *Prevotella* sp. P5-125 Cas13b protein; or (e) wherein said Cas13 protein is a Cas13b protein that comprises mutations corresponding to amino acid positions H133 and H1058 of a wild type *Prevotella* sp. P5-125 Cas13b protein; or (f) wherein said Cas13 protein is a Cas13b protein that comprises mutations corresponding to an H133A and an H1058A mutation of a wild type *Prevotella* sp. P5-125 Cas 13b protein.

7. The engineered composition of claim 5, wherein said Cas13 is a C-terminus truncated Cas13b, wherein the C-terminus truncated Cas13b corresponds to amino acids encoded by nt 1-984 of a *Prevotella* sp.P5-125 Cas13b, and wherein the Cas13 retains RNA binding ability.

8. The engineered composition of claim 3, wherein said guide molecule comprises a guide sequence capable of hybridizing with a target RNA sequence comprising a Cytidine to be edited to form an RNA duplex;

has a length of about 20-53 nt, 25-53 nt, 29-53 nt, or 40-50 nt capable of forming said RNA duplex with said target RNA sequence, and/or wherein a distance between a non-pairing C and a 5' end of said guide sequence is 20-30 nucleotides; or comprises more than one mismatch corresponding to different cytosine sites in the target RNA sequence or wherein two guide molecules are used, each comprising a mismatch corresponding to different cytosine sites in the target RNA sequence.

9. The engineered composition of claim 1, wherein said targeting domain, said cytidine deaminase protein or catalytic domain thereof, or both comprise one or more heterologous nuclear export signal(s) (NES(s)) or nuclear localization signal(s) (NLS(s)), operatively coupled to a C-terminus, wherein the NES(s) is/are independently selected from an HIV Rev NES or MAPK NES.

10. The engineered composition of claim 8, wherein said target RNA is within a eukaryotic cell, wherein the eukaryotic cell is a human cell, a non-human animal cell, or a plant cell.

11. The engineered composition of claim 1, wherein the Cas13 protein or fragment thereof is or is derived from a Cas13b from a bacterial species selected from the group consisting of *Porphyromonas gulae, Prevotella* sp., *Porphyromonas gingivalis, Bacteroides pyogenes, Riemerella anatipestifer, Bergeyella zoohelcum, Prevotella intermedia, Prevotella buccae, Alistipes* sp., *Prevotella aurantiaca, Myroides odoratimimus, Capnocytophaga canimorsus, Flavobacterium branchiophilum*, and *Flavobacterium columnare.*

12. A modified cell comprising the engineered composition of claim 1, or progeny of said modified cell.

13. The modified cell or progeny thereof of claim 12, wherein said modified cell is a eukaryotic cell, wherein the eukaryotic cell is (a) a human cell, (b) a non-human animal cell, (c) a plant cell, (d) a therapeutic T cell, (e) an antibody-producing B-cell, or any combination of (a) or (b) with (d) or (e).

14. A non-human animal or plant comprising said modified cell or progeny thereof of claim 13.

15. The modified cell of claim 12, wherein said modified cell comprises a Uracil or a Thymine in place of a Cytosine in a target RNA compared to a corresponding cell not comprising said engineered composition.

16. An engineered composition for site-directed base editing of an RNA comprising:

a Cas13 protein or fragment thereof, which retains RNA binding ability;

a guide molecule; and a cytidine deaminase or a catalytic domain thereof, wherein the cytidine deaminase protein or the catalytic domain thereof is an apolipoprotein B mRNA-editing complex (APOBEC) family deaminase and directly fused to or linked via a flexible linker to a C-terminus of the Cas13 protein or fragment thereof which retains RNA binding ability, and wherein the APOBEC family deaminase is an APOBEC1 deaminase comprising one or more mutations corresponding to W90A, W90Y, W90F, R118A, H121R, H122R, R126A, R126E, or R132E in rat APOBEC1, or an APOBEC3G deaminase comprising one or more mutations corresponding to W285A, W285Y, W285F, R313A, D316R, D317R, R320A, R320E, or R326E in human APOBEC3G, and wherein the Cas13 protein or fragment thereof is or is derived from a Cas13 from a bacterial species selected from any one of

*Leptotrichia buccalis* C-1013-b, *Herbinix hemicellulosilytica,* [*Eubacterium*] *rectale, Eubacteriaceae bacte-*

*rium* CHKCI004, *Blautia* sp. Marseille-P2398, *Chloroflexus aggregans, Demequina aurantiaca, Thalassospira* sp. TSL5-1, SAMN04487830_13920 [*Pseudobutyrivibrio* sp. OR37], SAMN02910398_00008 [*Butyrivibrio* sp. YAB3001], *Leptotrichia* sp. Marseille-P3007, *Bacteroides ihuae*, SAMN05216357_1045 [*Porphyromonadaceae bacterium* KH3CP3RA], *Listeria riparia, Insolitispirillum peregrinum, Prevotella intermedia, Porphyromonas gingivalis, Bacteroides pyogenes, Riemerella anatipestifer, Prevotella aurantiaca, Prevotella saccharolytica*, HMPREF9712_03108 [*Myroides odoratimimus* CCUG 10230], *Flavobacterium branchiophilum, Myroides odoratimimus, Flavobacterium columnare, Porphyromonas* sp. COT-052 OH4946, PIN17_0200 [*Prevotella intermedia* 17], HMPREF9144 1146 [*Prevotella pallens* ATCC 700821], HMPREF9714_02132 [*Myroides odoratimimus* CCUG 12901], HMPREF9711_00870 [*Myroides odoratimimus* CCUG 3837], HMPREF9151_01387 [*Prevotella saccharolytica* F0055], A343_1752 [*Porphyromonas gingivalis* JCVI SC001], HMPREF1981_03090 [*Bacteroides pyogenes* F0041], HMPREF1553_02065 [*Porphyromonas gingivalis* F0568], HMPREF1988_01768 [*Porphyromonas gingivalis* F0185], HMPREF1990_01800 [*Porphyromonas gingivalis* W4087], M573_117042 [*Prevotella intermedia* ZT], A2033_10205 [*Bacteroidetes bacterium* GWA2_31_9], SAMN05421542_0666 [*Chryseobacterium jejuense*], SAMN05444360_11366 [*Chryseobacterium carnipullorum*], SAMN05421786_1011119 [*Chryseobacterium ureilyticum*], *Prevotella pallens, Prevotella* sp. MSX73, *Psychroflexus torquis, Prevotella pleuritidis, Prevotella falsenii, Capnocytophaga cynodegmi, Prevotella* sp. P5-119, *Prevotella* sp. P4-76, *Prevotella* sp. P5-60, *Flavobacterium* sp. 316, *Chryseobacterium* sp. YR477, *Sinomicrobium oceani, Reichenbachiella agariperforans, Fusobacterium necrophorum* subsp. *funduliforme, Fusobacterium necrophorum, Fusobacterium necrophorum* DJ-2, *Fusobacterium necrophorum* BFTR-1, *Fusobacterium perfoetens, Fusobacterium ulcerans, Anaerosalibacter massiliensis*, or *Anaerosalibacter* sp. ND11.

17. The engineered composition of claim 16, wherein the Cas13 protein is a dead Cas 13 (dCas13).

18. A method of modifying a Cytosine in a target RNA, comprising delivering to said target RNA, the engineered composition according to claim 1.

19. The method of claim 18, wherein said guide molecule forms a complex with the Cas 13 protein and directs said complex to bind said target RNA, wherein a guide sequence of the guide molecule is capable of hybridizing with a target RNA sequence comprising said Cytosine to form an RNA duplex; wherein said cytidine deaminase protein or catalytic domain thereof deaminates said Cytosine in said RNA duplex.

20. The method of claim 18, wherein the Cas13 protein and the cytidine deaminase protein, or catalytic domain thereof, are delivered as one or more polynucleotide molecules, as a ribonucleoprotein complex, optionally via particles, vesicles, or one or more viral vectors.

21. The method of claim 18, wherein: (a) said Cytosine is outside said target RNA that forms an RNA duplex, wherein said cytidine deaminase protein or catalytic domain thereof deaminates said Cytosine outside said RNA duplex, or (b) said Cytosine is within said target RNA that forms said RNA duplex, wherein said guide molecule comprises a non-pairing Adenine or Uracil at a position corresponding to said Cytosine resulting in a C-A or C-U mismatch in said RNA duplex, and wherein the cytidine deaminase protein or catalytic domain thereof deaminates the Cytosine in the RNA duplex opposite to the non-pairing Adenine or Uracil.

22. The method of modifying a Cytosine in a target RNA of claim 18, wherein the Cas13 protein comprises a catalytically inactive Cas13 protein.

23. The method of claim 22, wherein said flexible linker is $(GGGGS)_{3-11}$ (SEQ ID NO: 1-9), $GSG_5$ (SEQ ID NO: 10) or LEPGEKPYKCPECGKSFSQSGALTRHQRTHTR (SEQ ID NO: 11) or an XTEN linker (SEQ ID NO: 66).

24. The method of claim 22, wherein said catalytically inactive Cas13 protein (a) comprises an HEPN domain comprising one or more mutations;
(b) has at least part of an HEPN domain removed;
(c) is a Cas13a, Cas13b, or Cas13c protein;
(d) is obtained from a Cas13a nuclease derived from a bacterial species selected from the group consisting of *Leptotrichia shahii, Lachnospiraceae bacterium, Lachnospiraceae bacterium, Clostridium aminophilum, Carnobacterium gallinarum, Paludibacter propionicigenes, Listeria weihenstephanensis, Listeriaceae bacterium, Listeria newyorkensis, Leptotrichia* wadei, Rhodobacter capsulatus, Rhodobacter capsulatus, Rhodobacter capsulatus, *Leptotrichia wadei*, or *Listeria seeligeri;*
(e) obtained from a Cas13b nuclease derived from a bacterial species selected from the group consisting of *Porphyromonas gulae, Prevotella* sp., *Porphyromonas gingivalis, Bacteroides pyogenes, Riemerella anatipestifer, Bergeyella zoohelcum, Prevotella intermedia, Prevotella buccae, Alistipes* sp., *Prevotella aurantiaca, Myroides odoratimimus, Capnocytophaga canimorsus, Flavobacterium branchiophilum*, and *Flavobacterium columnare;*
(f) has been modified to and recognizes an altered PAM sequence;
(g) any combination of (a), (b), (c) and (f) with (d) or (e).

25. The method of claim 22, wherein said guide molecule binds to said catalytically inactive Cas13 protein and is capable of forming an RNA duplex of about 15-30 nt with said target RNA;

binds to said catalytically inactive Cas13 protein and is capable of forming said RNA duplex of more than 30 nt with said target RNA;

comprises at least one further non-pairing nucleotide with said target RNA, adjacent to a non-pairing Adenine or Uracil; or comprises a stretch of three to five consecutive non-pairing nucleotides with said target RNA.

26. The method of claim 22, wherein said cytidine deaminase protein or catalytic domain thereof is delivered together with a uracil glycosylase inhibitor (UGI), where said UGI is covalently linked to said cytidine deaminase protein or catalytic domain thereof and/or said catalytically inactive Cas13 protein.

27. The method of claim 22, wherein said catalytically inactive Cas13 protein, said cytidine deaminase protein or catalytic domain thereof, or both comprise one or more heterologous nuclear export signal(s) (NES(s)).

28. The method of claim 22, wherein said method comprises, determining said target RNA and selecting the cytidine deaminase protein or catalytic domain thereof which most efficiently deaminates said Cytosine present in said target RNA.

29. The method of claim 18, wherein said target RNA is within a cell, or within an animal or a plant, or comprised in a DNA molecule in vitro.

30. The method of claim 29, wherein said cell is a eukaryotic cell, a non-human animal cell, a human cell, or a plant cell.

31. The method of claim 18, wherein one or more components of the engineered composition are delivered to a cell as a ribonucleoprotein complex or as one or more polynucleotide molecules.

32. The method of claim 31, wherein (a) said one or more polynucleotide molecules comprise one or more mRNA molecules encoding the targeting domain and/or the cytidine deaminase protein or catalytic domain thereof;

(b) are comprised within one or more vectors;

(c) comprise one or more regulatory elements operably configured to express said targeting domain, said guide molecule, and said cytidine deaminase protein or catalytic domain thereof, optionally wherein said one or more regulatory elements comprise inducible promoters; or (d) any combination of (a)-(c).

33. The method of claim 31, wherein said one or more polynucleotide molecules or said ribonucleoprotein complex are delivered via particles, vesicles, or one or more viral vectors.

34. The method of claim 33, wherein said particles comprise a lipid, a sugar, a metal, a protein, or a lipid nanoparticle.

35. The method of claim 33, wherein said vesicles comprise exosomes or liposomes.

36. The method of claim 33, wherein said one or more viral vectors comprise one or more of adenovirus, one or more lentivirus or one or more adeno-associated virus.

37. The method of claim 18, wherein the target RNA modified is in a cell or an organism, such that the method modifies the cell or organism, and wherein the target RNA modified corresponds to a target a genomic loci of interest.

38. The method of claim 37, wherein deamination of said Cytosine at said target RNA remedies a disease caused by a T(U)→C or A→G point mutation or pathogenic SNP or inactivates a gene transcript.

39. A method for cell therapy, comprising administering to a patient in need thereof said modified cell of claim 15, wherein presence of said modified cell remedies a disease in said patient.

* * * * *